United States Patent 11,141,474 (ARTIFICIAL NUCLEIC ACID MOLECULES ENCODING A NOROVIRUS ANTIGEN AND USES THEREOF) - sequence listing, part 12

SEQ ID NO: 25997 - RNA, 1614 nt, Artificial Sequence
  derived and/or modified sequence opt4 from VP1__Norovirus_and/or_Norovirus-like__KX514199
augaagauggccagcagcgacgccaaccccagcgacggcagcgccgccaaccuggugcccgaggugaacaacgaggugauggcccuggagcccguggugggcgccgccaucguggcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugaccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcugcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25998 - RNA, 1614 nt, Artificial Sequence
  derived and/or modified sequence opt4 from VP1__Norovirus_and/or_Norovirus-like__KX514176
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugaccagaaucggcaccacccagcacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25999 - RNA, 1614 nt, Artificial Sequence
  derived and/or modified sequence opt4 from VP1__Norovirus_and/or_Norovirus-like__KX514360
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26000 - RNA, 1614 nt, Artificial Sequence
  derived and/or modified sequence opt4 from VP1__Norovirus_and/or_Norovirus-like__KX514347
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccacggcaugcugacccagaccacccagggcagcggcagcaccagagcccacagagccaccguguacgugggcggcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugcugcccagcaacggcuacuucagauucgacagcugggugaaccaguucuacacccuggcccccaugggcaacggcaccggcagaagaagauga

SEQ ID NO: 26001 - RNA, 1614 nt, Artificial Sequence
  derived and/or modified sequence opt4 from VP1__Norovirus_and/or_Norovirus-like__AB684675
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuuccugggcgacgugaccagagugggcaccagccacgacuacaccaugaaccuggugagccagaacugggacaacuacgaccccaccgaggagauccccgccccccugggcacccccgacuucgugggcaagauccagggccugcugacccagaccaccagagccgacagaagcacccccgcccacaaggccaccgugagcaccggcagcgugcacuucacccccaagcugggcagcgugcaguucaccaccgacaccaacaacgacuuccagaccggccagaacaccaaguucacccccgugggcgugauccaggacagcgaccaccaccagaacgagccccagcagugggugcugcccaacuacagcggcaccaccggccacaacgugcaccuggcccccgccguggcccccaccuuccccggcgagcagcugcuguucuucagagugaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 26002 - RNA, 1614 nt, Artificial Sequence
  derived and/or modified sequence opt4 from VP1__Norovirus_and/or_Norovirus-like__KX514369
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcgccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26003 - RNA, 1614 nt, Artificial Sequence
  derived and/or modified sequence opt4 from VP1__Norovirus_and/or_Norovirus-like__KX514310
augaagauggccagcaacgacaccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagcaagaucuacaccaugaaccuggccagccccaacuggaacaacuacgaccccaccgaggagauccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26004 - RNA, 1614 nt, Artificial Sequence
  derived and/or modified sequence opt4 from VP1__Norovirus_and/or_Norovirus-like__KX514185
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcggccugcugggcaccacccagcugagcagcgugaacaucugcaccuucagaggcgacgugacccacaucggcaccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26005 - RNA, 1614 nt, Artificial Sequence
  derived and/or modified sequence opt4 from VP1__Norovirus_and/or_Norovirus-like__KX514181
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcaguucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26006 - RNA, 1614 nt, Artificial Sequence
  derived and/or modified sequence opt4 from VP1__Norovirus_and/or_Norovirus-like__KF712493
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcggcguggaguucacccccaagcugggcagaauccagcuguucaccgacaccgacaacgaccuggaggccaaccagaacaccaaguucacccccgugggcgugauccaggacggcgacacccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuguucaucccccccaacggcuacuucagauucgacagcugggugagccccuucuacacccuggcccccaugggcaacggcaccggcagaagaagauga

SEQ ID NO: 26007 - RNA, 1614 nt, Artificial Sequence
  derived and/or modified sequence opt4 from VP1__Norovirus_and/or_Norovirus-like__FJ411169
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgccgacguguucaccgugagcagaagagugcugaccagacccagccccgacuucgacuucaucuucagcgugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 26008 - RNA, 1614 nt, Artificial Sequence
  derived and/or modified sequence opt4 from VP1__Norovirus_and/or_Norovirus-like__AF427121
augaagauggccagcaacgacgccaaccccagcgacggcagcaccgccaaccuggugcccgaggugaacaacgaggugaugacccuggagcccguggugggcgccgccaucgccgcccccguggccggccagcagaacgugaucgaccccuggaucggcaacaacaucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccguguucccccacaucaucguggacgugagacagcuggagcccgugcugaucccccugcccgacgugagaaacaacuuccaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccaucgagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccagcaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaacagcgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 26009 - RNA, 1614 nt, Artificial Sequence
  derived and/or modified sequence opt4 from VP1__Norovirus_and/or_Norovirus-like__KF429787
augaagauggccagcaacgacgccacccccagcgacggcagcagcgccaaccuggugcccgaggccaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccugagcagaauguacaacggcuacgccggcagcuucgaggugcaggugauccuggccggcaacgccuucaccgccggcaagaucaucuucgccgccgugccccccaacuucagaaccgagggccugagccccagccagaucaccauguucccccacaucaucaccgacgugagacagcuggagcccgugcugaucccccugcccgacaucagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugaccagaaucggcaacagcagagaguacagaaugaaccuggccagccugaacuggaacaacuacgaccccaccgaggagauccccgccccccugggcacccccgacuucgccggcaagauccagggcgugcugacccagaccaccagacacgacggcagcaccagaggccacaaggccaccguguacaccggcagcgccggcuucacccccaagcugggcagcgugcaguucagcaccgacaccgacaacgaccuggaggccaaccagaacaccagauucacccccgugggcgugauccaggacggcaacgcccaccagggcgagccccagcagugggugcugcccaacuacgccggcagagacggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 26010 - RNA, 1614 nt, Artificial Sequence
  derived and/or modified sequence opt4 from VP1__Norovirus_and/or_Norovirus-like__AB933728
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccaucccccccaacuuccccaccgagggccugagccccagccaggugaccauguucccccacaucgugguggacgugagacagcuggagcccgugcugaucccccugcccgacgugagaaacaacuucuaccacuacaaccagaccaaggagagcaccaucaagcugguggccaugcuguacaccccccugagagccaacaacgccggcgacgacguguucaccgugagcugcagagugcugaccagacccagccccgacuucgacuucaucuuccuggugccccccagcguggagagcagaaccaagcccuucaccgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugaccagagugagcaccacccacguguacgagaugaaccuggccagccagaacuggaacaacuacgaccccaccgaggaggugcccgccccccugggcacccccgacuucgugggcaagauccagggcgugcugacccagaccaccagaaccgacggcagcaccagagcccacaaggccaccgugagcaccggcgccgccgacuucacccccaagcugggcagcaucagauucgagaccaccaccaacagagaccuggagacccaccagaacaccaaguucacccccgugggcgugauccaggacggcgacaaccaccagaacgagccccagcaguggagacugcccggcuacgccggcagagacgcccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuaccugaccguggcccacaccggccccuacgaccuggugaucccccccaacggcuacuucagauucgacagcugggugaaccaguucuacacccuggcccccaugggcaacggcaccggcagaagaagauga

SEQ ID NO: 26011 - RNA, 1614 nt, Artificial Sequence
  derived and/or modified sequence opt4 from VP1__Norovirus_and/or_Norovirus-like__KX514346
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcagcaacuucacccccaagcugggcaaggugcccuucgagaccgacaccggcgacgaccuggccaucagacagaacaccaaguucacccccgugggcgugauccagagcagcggccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26012 - RNA, 1614 nt, Artificial Sequence
  derived and/or modified sequence opt4 from VP1__Norovirus_and/or_Norovirus-like__KX514249
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgaccugaucuuccuggugccccccaccguggagagcagaaccaagcccuucagcgugcccauccugaccgugggcgagaugaccaacagcagauuccccaucaaccuggagggccuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugcaguucaagaccgagaccaaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26013 - RNA, 1614 nt, Artificial Sequence
  derived and/or modified sequence opt4 from VP1__Norovirus_and/or_Norovirus-like__KF429760
augaagauggccagcaacgacgccacccccagcgacggcagcagcgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccugagcagaauguacaacggcuacgccggcagcuucgaggugcaggugauccuggccggcaacgccuucaccgccggcaagaucaucuucgccgccgugccccccaacuucagaaccgagggccugagccccagccagaucaccauguucccccacaucaucaccgacgugagacagcuggagcccgugcugaucccccugcccgacaucagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugaccagaaucggcaacagcagagaguacagaaugaaccuggccagccugaacuggaacaacuacgaccccaccgaggagauccccgccccccugggcacccccgacuucgccggcaagauccagggcgugcugacccagaccaccagacacgacggcagcaccagaggccacaaggccaccguguacaccggcagcgccggcuucacccccaagcugggcagcgugcaguucagcaccgacaccgacaacgaccuggaggccaaccagaacaccagauucacccccgugggcgugauccaggacggcaacgcccaccagggcgagccccagcagugggugcugcccaacuacgccggcagagacggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 26014 - RNA, 1614 nt, Artificial Sequence
  derived and/or modified sequence opt4 from VP1__Norovirus_and/or_Norovirus-like__AB303929
augaagauggccagcaacgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguacaccggccccagcagcgccaucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucagcaccgacaccgacaacgacuuccagcccggccagaacaccaaguucacccccgugggcgugauccaggacggcgacagacaccagaacgagccccagcagugggugcugcccgacuucagcggcagaaccggccacaacgugcaccuggcccccgccguggcccccaccuuccccggcgagcagcugcuguucuucagaagcaccaugcccggcagaagcggcuaccccaacaugaaccuggacugccugcugccccaggagugggugcugcacuucuaccaggagagcgcccccgcccagagcgacguggcccugcugagauucgugaaccccgacaccaacagagugcuguucgagugcaagcugcacaagagcggcuacaucaccguggcccacaccggccaccacgaccugauccugccccccaacggcuacuucagauucgacagcugggugaaccaguucuacacccuggcccccaugggcaacggcgccggcagaagaagauga

SEQ ID NO: 26015 - RNA, 1614 nt, Artificial Sequence
  derived and/or modified sequence opt4 from VP1__Norovirus_and/or_Norovirus-like__KX514363
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugagauucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26016 - RNA, 1614 nt, Artificial Sequence
  derived and/or modified sequence opt4 from VP1__Norovirus_and/or_Norovirus-like__KX514357
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgacuucacccccaagcugggcaaggugcaguucgagaccgagaccgaccacgaccuggccaucagacagaacaccaaguucacccccgugggcgugauccaggagagcgacaaccacagagacgagccccagcaguggagacugcccaacuacagcggcgccaacaccuucaacgugcaccuggcccccgccguggcccccaacuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26017 - RNA, 1614 nt, Artificial Sequence
  derived and/or modified sequence opt4 from VP1__Norovirus_and/or_Norovirus-like__KX514240
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguuccagaccgagaccgaggacgaccuggugaucagacagaacaccaaguucacccccgugggcgugauccaggagagcgaccaccacagagacgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26018 - RNA, 1614 nt, Artificial Sequence
  derived and/or modified sequence opt4 from VP1__Norovirus_and/or_Norovirus-like__AF414417
augaagauggccagcaacgacgccaaccccagcgacggcagcgccgccaaccuggugcccgaggugaacaacgaggugauggcccuggagcccgugguggacgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccccaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccaugcugaucccccugcccgacgugagaaacaacuucuaccacuacaaccaggccaacgacagcacccugaagcugaucgccacccuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacguggcccacaucgccggcagccacgacuacaccaugaaccuggccagccagaacuggagcaacuacgaccccaccgaggagauccccgccccccugggcacccccgacuucgugggcaagauccagggccugcugacccagaccaccagagccgacggccugaccagagcccacaaggccaccgugagcaccggcagcgugcacuucacccccaagcugggcagcgugcaguucaccaccgacaccaacaacgacuuccaggccggccagaacaccaaguucacccccgugggcgugauccaggacggcgaccaccaccagaacgagccccagcaguggcugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugcugccccccaacggcuacuucagauucgacagcugggugaaccaguucuacacccuggcccccaugggcaacggcaccggcagaagaagauga

SEQ ID NO: 26019 - RNA, 1614 nt, Artificial Sequence
  derived and/or modified sequence opt4 from VP1__Norovirus_and/or_Norovirus-like__KX514303
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26020 - RNA, 1614 nt, Artificial Sequence
  derived and/or modified sequence opt4 from VP1__Norovirus_and/or_Norovirus-like__KX514273
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucaccggcaagauccagggcaugcugacccagaccaccaagggcgagggcagcaccagaggccacagagccaccguguacgugggcagcgccgaguucacccccaagcugggcaaggugagauucgagaccgacaccgaggacgaccuggugaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26021 - RNA, 1614 nt, Artificial Sequence
  derived and/or modified sequence opt4 from VP1__Norovirus_and/or_Norovirus-like__KX514323
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccggcaacagcaagaucuacaccaugaaccuggccagccccaacuggaacaacuacgaccccaccgaggagauccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26022 - RNA, 1614 nt, Artificial Sequence
  derived and/or modified sequence opt4 from VP1__Norovirus_and/or_Norovirus-like__KX514364
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggccccccugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26023 - RNA, 1614 nt, Artificial Sequence
  derived and/or modified sequence opt4 from VP1__Norovirus_and/or_Norovirus-like__KX514338
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaacuucguggugcagccccagaacggcagaugcaugaucgacggcgugcugcugggcaccacccagcugagccccgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccguggacgaccuggagaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26024 - RNA, 1614 nt, Artificial Sequence
  derived and/or modified sequence opt4 from VP1__Norovirus_and/or_Norovirus-like__KX514316
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaaagagauga

SEQ ID NO: 26025 - RNA, 1614 nt, Artificial Sequence
  derived and/or modified sequence opt4 from VP1__Norovirus_and/or_Norovirus-like__KX514356
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacugcuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaucaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgacuucacccccaagcugggcaaggugcaguucgagaccgagaccgaccacgaccuggccaucagacagaacaccaaguucacccccgugggcgugauccaggagagcgaccaccacagagacgagccccagcaguggagacugcccaacuacagcggcgccaacaccuucaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26026 - RNA, 1614 nt, Artificial Sequence
  derived and/or modified sequence opt4 from VP1__Norovirus_and/or_Norovirus-like__KX514349
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcggcgccgaguucacccccaagcugggcaaggugagauucgagaccgacaccgaggacgaccuggugaucagacagaacaccaaguucacccccgugggcgugauccagaccagcgagaaccacagagacgagccccagcaguggagacugcccaacuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26027 - RNA, 1614 nt, Artificial Sequence
  derived and/or modified sequence opt4 from VP1__Norovirus_and/or_Norovirus-like__KX514217
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccacccagggcagcggcagcaccagagcccacagagccaccguguacgugggcagcgccgaguucacccccaagcugggcaaggugcaguuccagaccgagaccgaccacgaccuggugaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26028 - RNA, 1614 nt, Artificial Sequence
  derived and/or modified sequence opt4 from VP1__Norovirus_and/or_Norovirus-like__KX514324
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccacagcggcaacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcggcgccaacuucacccccaagcugggcaaggugcaguucgagaccgacaccguggacgaccuggagaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26029 - RNA, 1614 nt, Artificial Sequence
  derived and/or modified sequence opt4 from VP1__Norovirus_and/or_Norovirus-like__KX514306
augaagauggccagcagcgacgccaaccccagcgacggcagcaccgccaaccuggugcccgaggugaacaacgaggugauggcccuggagcccguggugggcguggccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaucgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccagcacuggaccaugaaccuggccagccccaacuggaacaacuacgaccccaccgaggagacccccgccccccugggcacccccgacuucgugggcaagauccagggcaugcugacccagaccacccaggagaacggcagcaccagagcccacagagccaccguguacgugggcggcgccaacuacgcccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacgugacccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26030 - RNA, 1614 nt, Artificial Sequence
  derived and/or modified sequence opt4 from VP1__Norovirus_and/or_Norovirus-like__AB186063
augaagauggccagcaacgacgugaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucagcaccgacaccgacaacgacuuccagcccggccagaacaccaaguucacccccgugggcgugauccaggacggcgacagacaccagaacgagccccagcagugggugcugcccgacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggagagcgcccccgcccagagcgacguggcccugcugagauucgugaaccccgacaccaacagagugcuguucgagugcaagcugcacaagagcggcuacaucaccguggcccacaccggccagcacgaccugauccugccccccaacggcuacuucagauucgacagcugggugaaccaguucuacacccuggcccccaugggcaacggcgccggcagaagaagauga

SEQ ID NO: 26031 - RNA, 1614 nt, Artificial Sequence
  derived and/or modified sequence opt4 from VP1__Norovirus_and/or_Norovirus-like__AF406793
augaagauggccagcagcgacgccaaccccagcgacggcagcaccgccaaccuggugcccgaggugaacaacgaggugauggcccuggagcccguggugggcgccgccaucgccggccccguggccggccagcagaacgugaucgaccccuggaucagaaacaacuucgugcaggcccccggcggcgaguucaccgugagccccaccaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgccagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcguguucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagccaccaaggccaccgugagcaccggcagcgugcacuucacccccaagcugggcagcgugcaguacaccgccgacaccaacaacgacuuccagaccggccagaacaccaaguucacccccgugggcgugauccaggacggcagcaaccaccagaacgagccccagcagugggugcugaccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgaccccugggugaaccaguucuacacccuggcccccaugggcaacggcgccggcagaagaagauga

SEQ ID NO: 26032 - RNA, 1614 nt, Artificial Sequence
  derived and/or modified sequence opt4 from VP1__Norovirus_and/or_Norovirus-like__KX514223
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgacuucacccccaagcugggcaaggugcaguucgagaccgagaccgaccacgaccuggccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccgacgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26033 - RNA, 1614 nt, Artificial Sequence
  derived and/or modified sequence opt4 from VP1__Norovirus_and/or_Norovirus-like__KX514318
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaugaucgacggcgugcugcugggcaccacccagcugagccccgugaacaucugcaccuucagaggcgacgugacccaccccggcggcagcaagaucuacaccaugaaccuggccagccccaacuggaacaacuacgaccccaccgaggagauccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccgaggacgaccuggccaucagacagaacaccaaguucacccccgugggcgugauccagagcagcgaccaccacagagacgagccccagcaguggagacugcccaacuacagcggcagagacacccccaacgugcaccuggcccccaccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacgugacccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26034 - RNA, 1614 nt, Artificial Sequence
  derived and/or modified sequence opt4 from VP1__Norovirus_and/or_Norovirus-like__AB186065
augaagauggccagcaacgacgugaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagagcuucaccgugcccgugcugaccguggaggagaugaccaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcauccccgacuucgugggcaagauccagggccugcugacccagaccaccagagccgacggcagcaccagagcccacaaggccaccgugagcaccggcagcgugcacuucacccccaagcugggcagcgugcaguucagcaccgacaccgacaacgacuuccagcccggccagaacaccaaguucacccccgugggcgugauccaggacggcgacagacaccagaacgagccccagcagugggugcugcccgacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggagagcgcccccgcccagagcgacguggcccugcugagauucgugaaccccgacaccaacagagugcuguucgagugcaagcugcacaagagcggcuacaucaccguggcccacaccggccagcacgaccugauccugccccccaacggcuacuucagauucgacagcugggugaaccaguucuacacccuggcccccaugggcaacggcgccggcagaagaagauga

SEQ ID NO: 26035 - RNA, 1614 nt, Artificial Sequence
  derived and/or modified sequence opt4 from VP1__Norovirus_and/or_Norovirus-like__KX514307
augaagauggccagcagcgacgccaaccccagcgacggcagcaccgccaaccuggugcccgaggugaacaacgaggugauggcccuggagcccguggugggcgccgccaucgccgcccccguggugggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaugaucgacggcgugcugcugggcaccacccagcugagccccgugaacaucugcaccuucagaggcgacgugacccaccccggcggcagcaagaucuacaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugagauucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26036 - RNA, 1614 nt, Artificial Sequence
  derived and/or modified sequence opt4 from VP1__Norovirus_and/or_Norovirus-like__LC048948
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccgugcuguacaccccccugagaaccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgagaccaccaugaaccuggccagccagaacuggagcaacuacgaccccacccagaagauccccgccccccugggcaccccccacuucgugggcaagauccagggccugcugacccagaccaccagagcccacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccacgagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuucgaccugggcaucccccccaacggcuacuucagauucgacagcugggugaaccaguucuacacccuggcccccaugggcaacggcaccggcagaagaagauga

SEQ ID NO: 26037 - RNA, 1614 nt, Artificial Sequence
  derived and/or modified sequence opt4 from VP1__Norovirus_and/or_Norovirus-like__LC048908
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggccagccagaacuggagcaacuacgaccccaccgaggagauccccgccccccugggcacccccgacuucgugggcaagauccagggccugcugacccagaccaccagagcccacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggagaccgcccccgcccagcccgacguggcccugcugagauucgugaaccccgacaccagcagagugcugugcgagugcaagcugcccaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 26038 - RNA, 1614 nt, Artificial Sequence
  derived and/or modified sequence opt4 from VP1__Norovirus_and/or_Norovirus-like__KX514312
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccggcggcagcaagaucuacaccaugaaccuggccagccccaacuggaacaacuacgaccccaccgaggagauccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 26039 - RNA, 1614 nt, Artificial Sequence
  derived and/or modified sequence opt4 from VP1__Norovirus_and/or_Norovirus-like__KX514237
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggugggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccacccagggcagcggcagcaccagagcccacagagccaccguguacgugggcagcgccgacuucacccccaagcugggcaaggugcaguucgagaccgagaccgaccacgaccuggccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcugggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 26040 - RNA, 1614 nt, Artificial Sequence
  derived and/or modified sequence opt4 from VP1__Norovirus_and/or_Norovirus-like__DQ419907
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacagcagcgugcaggcccccggcggcgaguucaccgugagccccagagacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgccccccccaacuuccccaccgagggccugagccccagccaggugaccauguucccccacaucaucgugggcgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaacugcagcagagugcccgccgugccccugagcagcaaccacaagaugcagugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 26041 - RNA, 1614 nt, Artificial Sequence
  derived and/or modified sequence opt4 from VP1__Norovirus_and/or_Norovirus-like__JN975543
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcaccgccuacgugcccggcgacagagccgccccccugggcuaccccgacuucagcggccagcuggagaucgaggugcagaccgagaccaccaaggccggcgacaagcugaaggugaccaccuucgagaugauccugggccccaccaccaacguggaccaggcccccuaccagggcagaguguacgccagcaucaccgccauggccagccuggaccugguggacggcagagugagagccgugcccagaagcaucuacagcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcgcccugaccuuccccaccgacggcuucuucgagguggugagcugggugcccagacuguaccagcuggccagcgugggcagccuggccaccggcagauga

SEQ ID NO: 26042 - RNA, 1614 nt, Artificial Sequence
  derived and/or modified sequence opt4 from VP1__Norovirus_and/or_Norovirus-like__JN975541
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcaccgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagaguguacgccagcaucaccgccgccgccagccuggaccugguggacggcagagugagagccgugcccagaagcaucuacagcuuccaggacgccauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcgcccugaccuuccccaccgacggcuucuucgagguggugagcugggugcccagacuguaccagcuggccagcgugggcagccuggccaccggcagauga

SEQ ID NO: 26043 - RNA, 1614 nt, Artificial Sequence
  derived and/or modified sequence opt4 from VP1__Norovirus_and/or_Norovirus-like__KF113526
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccgccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgagaugauccugggccccaccaccaacguggaccaggcccccuaccagggcagaguguacgccagccugaccgccgccgccagccuggaccugguggacggcagagugagagccgugcccagaagcaucuacggcuuccaggaccagauccccgaguacaacgacggccugcuggugccccuggccccccccgugggccccuuccugcccggcgagcugcugcugagauucagaaccuacaugagacagaucgacagcgccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagauga

SEQ ID NO: 26044 - RNA, 1614 nt, Artificial Sequence
  derived and/or modified sequence opt4 from VP1__Norovirus_and/or_Norovirus-like__KF113527
augagaaugagcgacggcgccgcccccaaggccaacggcagcgaggccagcggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacgcccccggcgagauccuguucgaccuggcccugggccccggccugaaccccuaccuggcccaccugagcgccauguacaccggcugggugggcaacauggaggugcagcuggugcuggccggcaacgccuucaccgccagcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaaggccggcgacaagcugaaggugaccaccuucgagaugauccugggccccaccaccaacguggaccaggcccccuaccagggcagaguguacgccagccugaccgccgccgccagccuggaccugguggacggcagagugagagccgugcccagaagcaucuacggcuuccaggaccagauccccgaguacaacgacggccugcuggugccccuggccccccccgugggccccuuccugcccggcgagcugcugcugagauucagaaccuacaugagacagaucgacagcgccgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagauga

SEQ ID NO: 26045 - RNA, 1614 nt, Artificial Sequence
  derived and/or modified sequence opt4 from VP1__Norovirus_and/or_Norovirus-like__KM458057
augagaaugagcgacggcgccgcccccaaggccgacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugauccagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggccagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcaagguguucgccagcaucaccgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacguguucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagccuggccaccggcagauga

SEQ ID NO: 26046 - RNA, 1614 nt, Artificial Sequence
  derived and/or modified sequence opt4 from VP1__Norovirus_and/or_Norovirus-like__AB662855
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggccacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacgugcccgccccccugggcgugcccgacuuccagggcagaguguucggcgugaucagccagagagacaagcagaacgccgccggccacaacgagcccgccaacagaggccacgacgccguggugcccaccuacaccgcccaguacacccccaagcugggccaggugcagaucggcaccuggcagaccgacgaccugcaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcuga

SEQ ID NO: 26047 - RNA, 1614 nt, Artificial Sequence
  derived and/or modified sequence opt4 from VP1__Norovirus_and/or_Norovirus-like__AB809997
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgagagagagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcuga

SEQ ID NO: 26048 - RNA, 1614 nt, Artificial Sequence
  derived and/or modified sequence opt4 from VP1__Norovirus_and/or_Norovirus-like__AB810001
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcuga

SEQ ID NO: 26049 - RNA, 1614 nt, Artificial Sequence
  derived and/or modified sequence opt4 from VP1__Norovirus_and/or_Norovirus-like__AB809992
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggaguggguggaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcuga

SEQ ID NO: 26050 - RNA, 1611 nt, Artificial Sequence
  derived and/or modified sequence opt4 from VP1__Norovirus_and/or_Norovirus-like__AY130761
augaagauggccagcaacgacgccacccccagcgacgacggcgccgccggccuggugcccgagaucaacaacgaggugauggcccuggagcccguggccggcgccagcaucgccgcccccguggugggccagcagaacaucaucgaccccuggaucagaaacaacuucgugcaggcccccgccggcgaguucaccgugagccccagaaacagccccggcgagcugcugcuggaccuggagcugggccccgagcugaaccccuaccuggcccaccuggccagaauguacaacggccacgccggcggcauggaggugcagaucgugcuggccggcaacgccuucaccgccggcaagauccuguucgccgccaucccccccagcuuccccuacgagaaccugagccccgcccagcugaccaugugcccccacgugaucguggacgugagacagcuggagcccgugcugcugcccaugcccgacaucagaaacguguucuaccacuacaaccagaacaacagccccaagcugagacugguggccaugcuguacaccccccugagagccaacaacagcggcgacgacguguucaccgugagcugcagagugcugaccagacccagccccgacuuccaguucaccuuccuggugccccccaccguggagagcaagaccaagaacuucacccugcccgugcugagagugagcgagaugaccaacagcagauuccccguggugcuggaccagauguacaccagcagaaacgagaacaucaucgugcagccccagaacggcagaugcaccaccgacggcgagcugcugggcaccaccacccugcagagcgugagcaucugcaacuucagaggcaccaugcaggccaagcugaacgagcagcccagauaccagcugcagcugaccaaccuggacggcagccccaucgaccccaccgacgacaugcccgccccccugggcacccccgacuuccaggccaugcuguacggcguggccagccagagaagcagcagagacaacgccaccagagcccacgacgcccagaucgacaccgccggcgacaccuucgcccccaagaucggccaggugagauucaagagcagcagcgacgacuucgaccugcacgaccccaccaaguucacccccaucggcgugaacguggacgaccagcaccccuucagacaguggagccugcccaacuacggcggccaccuggcccugaacaaccaccuggcccccgccgugaccccccuguuccccggcgagcagauccuguucuucagaagccacauccccagcgccggcggccacaccgacggcgccaucgacugccugcugccccaggaguggaucgagcacuucuaccaggaggccgcccccagccagagcgacaucgcccuggugagauucaucaaccccgacaccggcagagugcugcuggaggccaagcugcacaagcagggcuuccugaccguggccgccagcggcgaccaccccaucgugaugcccaccaacggcuacuucagauucgaggccugggugaaccccuucuacacccuggcccccgugggcaccggcagcggcagaagaagaauccaguga

SEQ ID NO: 26051 - RNA, 1611 nt, Artificial Sequence
  derived and/or modified sequence opt4 from VP1__Norovirus_and/or_Norovirus-like__KF806495
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacgugagcgacaagaccuucgccaugaaccuggccagccccaacuggaacaacuacgaccccaccgaggacauccccgccccccugggcacccccgacuucgugggcagaauccacggcaugcugacccagaccaccagaagagacggcgccaccagaggccacaaggccaccgugagcaccggcggcgccgacuucacccccaagcugggcagcgugagauacaucaccgacaccaccgacgaccuggaggugagagagaacaccaaguucacccccaucggcgugcugcacagcagcggcgagcacagagccgagcccgaccaguggagacugcccgaguacagcggcagaaacgugcacaacgugcaccuggcccccgccguggcccccaccuuccccggcgagcagcugcuguucuucagaagcgcccugcccggcugcggcggcuaccccaacaccgaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26052 - RNA, 1611 nt, Artificial Sequence
  derived and/or modified sequence opt4 from VP1__Norovirus_and/or_Norovirus-like__KF806503
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaucaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggacgagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacgugagcgacaagaccuucgccaugaaccuggccagccccaacuggaacaacuacgaccccaccgaggagauccccgccccccugggcacccccgacuucgugggcagaauccacggcaugcugacccagaccaccagaagagacggcgccaccagaggccacaaggccaccgugagcaccggcggcgccgacuucacccccaagcugggcagcgugagauacaucaccgacaccaccgacgaccuggaggugagagagaacaccaaguucacccccaucggcgugcugcacagcagcggcgagcacagagccgagcccgaccaguggagacugcccgaguacagcggcagaaacgugcacaacgugcaccuggcccccgccguggcccccaccuuccccggcgagcagcugcuguucuucagaagcgcccugcccggcugcggcggcuaccccaacaccgaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26053 - RNA, 1611 nt, Artificial Sequence
  derived and/or modified sequence opt4 from VP1__Norovirus_and/or_Norovirus-like__KF712506
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuucagcaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaaggagaacggcagcaccagagcccacaaggccaccguguacaccggcaccguggaguucacccccaagcugggcagaauccagcuguucaccgacaccgacaacgaccuggaggccaaccagaacaccaaguucacccccgugggcgugauccaggacggcgaccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugagccccuucuacacccuggcccccaugggcaacggcaccggcagaagaagauga

SEQ ID NO: 26054 - RNA, 1611 nt, Artificial Sequence
  derived and/or modified sequence opt4 from VP1__Norovirus_and/or_Norovirus-like__KF712507
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuucagcaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcaccguggaguucacccccaagcugggcagaauccagcuguucaccgacaccgacaacgaccuggaggccaaccagaacaccaaguucacccccgugggcgugauccaggacggcgaccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugagccccuucuacacccuggcccccaugggcaacggcaccggcagaagaagauga

SEQ ID NO: 26055 - RNA, 1611 nt, Artificial Sequence
  derived and/or modified sequence opt4 from VP1__Norovirus_and/or_Norovirus-like__JX401281
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcaugccccugagccccgagcugaaccccuaccugagccaccugagcagaauguacaacggcuacgccggcggcuucgaggugcaggugauccuggccggcaacgccuucaccgccggcaagaucaucuucgccgccaucccccccaacuuccccaccgacggccugagccccagccaggugaccauguucccccacaucaucguggacgugagacagcuggagcccgugcugaucccccugcccgacgugagaaacaacuucuaccacuacaaccaggccaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggacgagaugaccaacagcagauuccccaccccccuggagaagcugcacaccggccccaacaacagcaucguggugcagccccagaacggcagaugcaccaucgacggcgugcugcugggcaccacccagcugagcaccgugaacaucugcaacuucagaggcagcaccaccagagccggccagagccacgccuacaccaugaaccuggugagccagaacuggaacaacuacgaccccaccgaggagauccccgccccccugggcacccccgacuucgugggcaagaucgugggcaugcugagccagaccaccagagagaacagcagcaccagagcccacaaggccaccgugagcaccggcgacgcccacuucacccccaagagcggcagcgugcuguucaccaccgacaccgacgaccugcagaacggccagaacaccagauucacccccgugggcguggcccaggacggcgagccccaccagaacgagccccagcaguggagacugcccaacuacagcggcacccccggccacaacgugcaccuggccccccccguggcccccaccuuccccggcgagcagcugcuguucuucagaagcaccaugcccggcugcggcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaaggccggcuacaucaccgugagccacaccggccccuacgaccuggugaucccccccaacggcuacuucagauucgacagcugggugaaccaguucuacgcccuggcccccaugggcaccggcaccggcagaagaagauga

SEQ ID NO: 26056 - RNA, 1611 nt, Artificial Sequence
  derived and/or modified sequence opt4 from VP1__Norovirus_and/or_Norovirus-like__KF806526
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaaguucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaacaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagauga

SEQ ID NO: 26057 - RNA, 1611 nt, Artificial Sequence
  derived and/or modified sequence opt4 from VP1__Norovirus_and/or_Norovirus-like__KF806500
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26058 - RNA, 1611 nt, Artificial Sequence
  derived and/or modified sequence opt4 from VP1__Norovirus_and/or_Norovirus-like__KF806498
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26059 - RNA, 1611 nt, Artificial Sequence
  derived and/or modified sequence opt4 from VP1__Norovirus_and/or_Norovirus-like__KF429768
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuucagcaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagacccccgccccccugggcacccccgacuucgugggcaagauccagggcgugcugacccagaccaccaagggcaacggcagcaccagagcccacaaggccaccguguacaccggcaccguggaguucacccccaagcugggcagaauccagcuguucaccgacaccgacaacgaccuggaggccaaccagaacaccaaguucacccccgugggcgugauccaggacggcgaccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugagccccuucuacacccuggcccccaugggcaacggcaccggcagaagaagauga

SEQ ID NO: 26060 - RNA, 1611 nt, Artificial Sequence
  derived and/or modified sequence opt4 from VP1__Norovirus_and/or_Norovirus-like__KF806496
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcggcgaccuggaggugagagagaacaccaaguucacccccaucggcgugcugcacagcagcggcgagagaagagccgagcccgagcaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26061 - RNA, 1611 nt, Artificial Sequence
  derived and/or modified sequence opt4 from VP1__Norovirus_and/or_Norovirus-like__KF806499
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggagaccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26062 - RNA, 1611 nt, Artificial Sequence
  derived and/or modified sequence opt4 from VP1__Norovirus_and/or_Norovirus-like__KF806497
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacguggccggcgacaccuucgccaugaaccuggccagccugaacuggaacaacuacgaccccaccgaggagacccccgccccccugggcacccccgacuucgugggcagaauccacggcaugcugacccagaccaccagaagcgacggcgccaccagagcccacaaggccaccgugagcaccggcggcgccgacuucacccccaagcugggcagcgugagauacagcaccgacaccagcagcgaccuggaggugagagagaacaccaaguucacccccaucggcgugcugcacagcagcggcggccacagagccgagcccgaccaguggagacugcccgaguacagcggcagaaacgugcacaacgugcaccuggcccccgccguggcccccaccuuccccggcgagcagcugcuguucuucagaagcaccaugcccggcugcggcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 26063 - RNA, 1611 nt, Artificial Sequence
  derived and/or modified sequence opt4 from VP1__Norovirus_and/or_Norovirus-like__JN699046
augaugauggccagcaaggacgccagccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcagagugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccagcccaacagcagcgacuucgugccccaccugggcagcgugagcgugaccaccgccaucgacguggccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccagcagcgccagauga

SEQ ID NO: 26064 - RNA, 1611 nt, Artificial Sequence
  derived and/or modified sequence opt4 from VP1__Norovirus_and/or_Norovirus-like__AM263418
augaugauggccagcaaggacgccagccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucgugugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcagagugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccagcccaacagcagcgacuucgugccccaccugggcagcguggccgugaccaccgccaucgacguggccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccagcagcgccagauga

SEQ ID NO: 26065 - RNA, 1611 nt, Artificial Sequence
  derived and/or modified sequence opt4 from VP1__Norovirus_and/or_Norovirus-like__KT732278
augaugauggccagcaaggacgccacccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccagccccagccccgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcaaggugaucaaccugaccgagcuggacggcagccccuuccuggccuucgaggcccccgcccccaccggcuuccccgaccugggcaccagcgacuggcacaucgagaugagccugaacagcaacagccagagcagcggcaaccccauccugcugagagacauccagcccaacagcagcgacuucgugccccaccugggcagcguggccgugaccaccgccaucgacaccgccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccaacagcgccagauga

SEQ ID NO: 26066 - RNA, 1611 nt, Artificial Sequence
  derived and/or modified sequence opt4 from VP1__Norovirus_and/or_Norovirus-like__KT732277
augaugauggccagcaaggacgccacccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccagccccagccccgacuucaacuuccuguuccuggugccccccaccguggagcagaagaccagacccuucagcgugcccaacaucccccugcagcugcugagcaacagcagagugcccaaccugauccagagcauggugcccagccccgaccaggcccagaacgugcaguuccagaacggcagaugcaccaccgacggccagcugcugggcaccacccccgugagcgugagccagauccugaaguucagaggcaaggugagcgccggcagcaaggugaucaaccugaccgagcuggacggcagccccuuccuggccuucgaggcccccgcccccaccggcuuccccgaccugggcaccagcgacuggcacaucgagaugagccugaacagcaacagccagagcagcggcaaccccauccugcugagagacauccagcccaacagcagcgacuucgugccccaccugggcagcguggccgugaccaccgccaucgacaccgccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccaacagcgccagauga

SEQ ID NO: 26067 - RNA, 1611 nt, Artificial Sequence
  derived and/or modified sequence opt4 from VP1__Norovirus_and/or_Norovirus-like__KJ402295
augaugauggccagcaaggacgcccccagcagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcugagccccgaccaggcccagaacgugcaguuccagaacggcagaugcaccaccgacggccagcugcugggcaccacccccgugagcgugagccagauccugaaguucagaggcaaggugagcgccggcagcaaggugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccaccccaacagcagcgaguucgugccccaccugggcagcgugugcgugaccgccgccaucgagguggccggcgacuacaccggcaccauccaguggaccagccagcccagcaacgugacccccgugcccgacgugaacuucuggaccaucccccacuacggcagcaaccuggccgaggccagccagcuggcccccgugguguacccccccggcuucggcgaggccaucguguacuucaugagccccauccccggccccaacaccgcccacaagcccaaccuggugcccugccugcugccccaggaguucgugacccacuucgugagcgagcaggcccccagcaugggcgaggccgcccuggugcacuacguggaccccgacaccaacagaaaccugggcgaguucaagcuguaccccgagggcuucaucaccugcgugcccaacggcaccggcccccagcagcugccccugaacggcguguucguguucgccagcugggugagcagauucuaccagcugaagcccgugggcaccgccagcagcgccagauga

SEQ ID NO: 26068 - RNA, 1611 nt, Artificial Sequence
  derived and/or modified sequence opt4 from VP1__Norovirus_and/or_Norovirus-like__AF414406
augaugauggccagcaaggacgccagccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucgugugcugcgugccccccggcuuccagagcagaacccugagcaucgcccaggccacccuguucccccacaucaucgccgacgugagaacccuggagcccaucgagaucccccuggaggacgugagaaacacccuguaccacaccaacgacaaccagcccaccaugagacugcugugcaugcuguacaccccccugagaaccggcggcggcagcggcggcaccgacgccuucgugguggccggcagagugcugaccugccccagcagcgacuucaacuuccuguuccuggugccccccaccguggagcagaagaccagacccuucagcgugcccaacaucccccugcagcugcugagcaacagcagagugcccaaccugauccagagcauggugcccagccccgaccaggcccagaacgugcaguuccagaacggcagaugcaccaccgacggccagcugcugggcaccacccccgugagcgugagccagauccugaaguucagaggcaaggugagcgccggcagcagagugaucaaccugaccgagcuggacggcagccccuuccuggccuucgaggcccccgcccccaccggcuuccccgaccugggcaccagcgacuggcacguggagaugagccugaacagcaacagccagagcagcggcaaccccauccugcugagagacauccagcccaacagcagcgacuucgugccccaccugggcagcguggccgugaccaccgccaucgacguggccggcgacuacaccggcaccauccaguggaccagccagcccagcaacgugacccccgugcccgacgugaacuucuggaccaucccccaguacggcagcaaccuggccgaggccagccagcuggcccccgugguguacccccccggcuucggcgaggccaucguguacuucaugagccccauccccggccccaacaccgcccacaagcccaaccuggugcccagacugcugccccaggaguucgugacccacuucgugagcgagcaggcccccagcaugggcgaggccgcccuggugcacuacguggaccccgacaccaacagaaaccugggcgaguucaagcuguaccccgagggcuucgugaccugcaugcccaacggcaccggcccccagcagcugccccugaacggcguguucguguucgccagcugggugagcagauucuaccagcugaagcccgugggcaccgccagcagcgccagauga

SEQ ID NO: 26069 - RNA, 1611 nt, Artificial Sequence
  derived and/or modified sequence opt4 from VP1__Norovirus_and/or_Norovirus-like__AB039774
augaugauggccagcaaggacgccacccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacgugaucgccgacgugagaacccuggagccccuggagaucccccuggaggacgugagaaacacccuguaccacaacaacgacagccagcccaccaugagacugcugugcaugcuguacaccccccugagaaccggcggcggcagcggcggcaccgacgccuucgugguggccggcagagugcugaccugccccagccccgacuucaacuuccuguuccuggugccccccaccguggagcagaagaccagacccuucagcgugcccaacaucccccugcagaaccugagcaacagcagagugcccagccugauccagagcauggugcugagcaacgaccacgcccagaccgugcaguuccagaacggcagaugcaccaccgacggccaccugcugggcaccacccccgugagcgccggccagcugaugaaguucagaggcaaggugaccagcggcagcaaggugcugaaccugaccgagcuggacggcagccccuuccuggccuucgaggcccccgcccccgccggcuuccccgaccugggcaagugcgacuggcacguggagaugagccuguaccaggacaacaaccacgccgaccccaucgugcugcacgccaucgagcccaacagcagcagcuucgugccccaccugggcagcgugagcuucaaggagaacgugaacguggccggcgacuacgugugcaccauccaguacaccagcccccccagcgacccccacaaccccaacgccgacguggacuucuggagcauccccgacuacggcagcaaccuggccgaggccagccagcuggcccccgugguguacccccccggcuucggcgaggccaucguguacuucaugagcagagugcccggcuggaacagaaccaacagacugaaccuggugcccugccugcugccccaggaguucaucggccacuucgugagcgagcaggcccccgccaucggcgaggccgcccugcugcacuacguggaccccgacaccaacagaaaccugggcgaguucaagcuguaccccgagggcuucaucaccugcgugcccaacggcaccggcccccagcagcugccccugaacggcguguucguguucagcagcugggugagcagauucuaccagcugaagcccgugggcaccgccagccuggccagauga

SEQ ID NO: 26070 - RNA, 1611 nt, Artificial Sequence
  derived and/or modified sequence opt4 from VP1__Norovirus_and/or_Norovirus-like__KP064095
auggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 26071 - RNA, 1608 nt, Artificial Sequence
  derived and/or modified sequence opt4 from VP1__Norovirus_and/or_Norovirus-like__AB045603
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26072 - RNA, 1608 nt, Artificial Sequence
  derived and/or modified sequence opt4 from VP1__Norovirus_and/or_Norovirus-like__AF397905
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26073 - RNA, 1608 nt, Artificial Sequence
  derived and/or modified sequence opt4 from VP1__Norovirus_and/or_Norovirus-like__AF414420
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucgccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgugcuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26074 - RNA, 1608 nt, Artificial Sequence
  derived and/or modified sequence opt4 from VP1__Norovirus_and/or_Norovirus-like__AF427119
augaagauggccagcagcgacgccgcccccagcaacgacggcgccgccggccuggugcccgaggccaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacagcuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgcccccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacaucuggaacaugcaggugaccaacaccaacggcacccccuucgaccccaccgaggacgugcccgccccccugggcacccccgacuucagcggcagacuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgagcacggcgacuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26075 - RNA, 1608 nt, Artificial Sequence
  derived and/or modified sequence opt4 from VP1__Norovirus_and/or_Norovirus-like__AB044366
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgaggacggcggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26076 - RNA, 1608 nt, Artificial Sequence
  derived and/or modified sequence opt4 from VP1__Norovirus_and/or_Norovirus-like__AB032758
augaagauggccagcaacgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccacccuggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccggcgacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacaccugggugaaccaguucuacagccuggcccccaugggcaccggcaacggcagaagaagagugcaguga

SEQ ID NO: 26077 - RNA, 1608 nt, Artificial Sequence
  derived and/or modified sequence opt4 from VP1__Norovirus_and/or_Norovirus-like__AB039775
augaagauggccagcagcgacgccgcccccagcaacgacggcgccgccggccuggugcccgaggccaacaacgagaccauggcccuggagcccguggccggcgccagcaucgccgccccccugaccggccagaacaacaucaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccacccugaccaucggcgagcugaccaacagcagauuccccgugcccaucgacgagcuguacaccagccccaacgagagccugguggugcagccccagaacggcagaugcgcccuggacggcgagcugagaggcaccacccagcugcugcccaccgccaucugccccuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggaggacgacgugcacaucaaccagcccaccaaguucacccccgugggccuguucgagaacgagggcuucaaccaguggacccugcccaacuacagcggcgcccugacccugaacaugggccuggccccccccguggcccccaccuuccccggcgagagaauccuguucuucagaagccacaucccccugaagggcggcguggccgaccccgugaucgacugccugcugcaccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26078 - RNA, 1608 nt, Artificial Sequence
  derived and/or modified sequence opt4 from VP1__Norovirus_and/or_Norovirus-like__AF414418
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccggccugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcagaagcacccuggacggcgagcugcugggcaccacccagcuggugcccagcaacaucugcagccugagaggcagaaucaacgcccaccugagcgacaaccagcacagauggaacaugcaggugaccaacgccaacggcacccccuucgaccccaccgaggacgugcccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26079 - RNA, 1608 nt, Artificial Sequence
  derived and/or modified sequence opt4 from VP1__Norovirus_and/or_Norovirus-like__AF425769
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcagaagcacccuggacggcgagcugcugggcaccacccagcuggugcccagcaacaucugcagccugagaggcagaaucaacgcccaccugagcgacaaccagcacagauggaacaugcaggugaccaacgugaacggcacccccuucgaccccaccgaggacgugcccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccgagcugcacagacagggcuucaucaccguggccaaccccggcagcagacccaucguggugccccccaacggcuacuucagauucgacagcugggugaaccaguucuacagccuggcccccaugggcaccggcaacggcagaagaagagugcaguga

SEQ ID NO: 26080 - RNA, 1608 nt, Artificial Sequence
  derived and/or modified sequence opt4 from VP1__Norovirus_and/or_Norovirus-like__AF414421
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcagacccacccuggacggcgagcugcugggcaccacccagcuggugcccagcaacaucugcagccugagaggcagaaucaacgcccaccugagcgacaaccagcacagauggaacaugcaggugaccaacgccaacggcacccccuucgaccccaccgaggacgcccccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26081 - RNA, 1608 nt, Artificial Sequence
  derived and/or modified sequence opt4 from VP1__Norovirus_and/or_Norovirus-like__AF414416
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucggcaaccugagccccggccagaucgccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggccugguggugcagccccagaacggcagaagcacccuggacggcgagcugcugggcaccacccagcuggugcccagcaacaucugcagccugagaggcagaaucaacgcccaccugagcgacaaccagcacagauggaacaugcaggugaccaacgccaacggcacccccuucgaccccaccgaggacgugcccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggugcugcccuacuacagcggcgcccugacccugaacaugaaccuggcccccagcguggccccccuguuccccggcgagcagcugcuguucuucagaagccacgugccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26082 - RNA, 1608 nt, Artificial Sequence
  derived and/or modified sequence opt4 from VP1__Norovirus_and/or_Norovirus-like__AF414419
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcugauccugaccaucggcgagcugagcaacagcagauuccccgcccccaucgacgagcuguacaccagccccaacgagggccugguggugcagccccagaacggcagaagcacccuggacggcgagcugcugggcaccacccagcuggugcccagcaacaucugcagccugagaggcagaaucaacgcccaccugagcgacaaccagcacagauggaacaugcaggugaccaacgccaacggcacccccuucgaccccaccgaggacgugcccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccgccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26083 - RNA, 1608 nt, Artificial Sequence
  derived and/or modified sequence opt4 from VP1__Norovirus_and/or_Norovirus-like__AF425767
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuuccccaucgagaaccugagccccggccagaucaccauguucccccacgugaucaucgacgugagaacccuggagcccgugcugcugccccugcccgacgugagaaacaacuucuuccacuacaaccaggaccccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcggcagcacccuggacggcgagcugcugggcaccacccagcuggugcccagcaacaucugcagccugagaggcagaaucaacgcccaccugagcgacaaccagcacagauggaacaugcaggugaccaacgugaacggcacccccuucgaccccaccgaggacgugcccgccccccugggcacccccgacuuccuggccaacaucuacggcaucaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26084 - RNA, 1608 nt, Artificial Sequence
  derived and/or modified sequence opt4 from VP1__Norovirus_and/or_Norovirus-like__DQ093065
augaagauggccagcaacgacgccgcccccagcaacgacggcgccgccggccuggugcccgaggugaacaacgagaugauggcccuggagcccguggccggcgccagcaucgccgccccccugaccggccagaacaacgugaucgaccccuggaucagaaugaacuucgugcaggcccccaacggcgaguucaccgugagccccagaaacagccccggcgagauccugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccaucccccccagauuccccaucgagaaccugagccccggccagaucaccauguucccccacgugaucaucgacgugagaacccuggagcccgugcugcugccccugcccgacgugagaaacaacuucuuccacuacaaccaggagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgcccccaucgacgagcuguacaccagccccaacgagggccugguggugcagccccagaacggcagaagcacccuggacggcgagcugcugggcaccacccagcuggugcccagcaacaucugcagccugagaggcagaaucaacgcccaccugcccgacaaccagcacagauggaacaugcaggugaccaacgccaacggcacccccuucgaccccaccgaggacgugcccgccccccugggcacccccgacuuccuggccaacaucuacggcgugaccagccagagaaaccccgacaacaccugcagagcccacgacggcauccuggccaccuggagccccaaguucacccccaagcugggcagcguggugcugggcaccugggaggacagagacuucgacaucaaccagcccaccagauucacccccgugggccuguacgacaccgaccacuucaaccagugggcccugcccaacuacagcggcgcccugacccugaacaugaaccuggcccccagcguggccccccuguuccccggcgagcagcugcuguucuucagaagccacaucccccugaagggcggcaccagcaacggcgccaucgacugccugcugccccaggagugggugcagcacuucuaccaggagagcgcccccagcagcaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26085 - RNA, 1608 nt, Artificial Sequence
  derived and/or modified sequence opt4 from VP1__Norovirus_and/or_Norovirus-like__KJ194507
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagaaugaacuucgugcaggcccccaacggcgaguucaccgugagccccagaaacagccccggcgaggugcugcugaaccuggagcugggccccgagcugaaccccuuccuggcccaccugagcagaauguacaacggcuacgccggcggcguggaggugcaggugcugcuggccggcaacgccuucaccgccggcaagcugguguucgccgccauccccccccacuucccccuggagaaccugagccccggccagaucaccauguucccccacgugaucaucgacgugagaacccuggagcccgugcugcugccccugcccgacgugagaaacaacuucuuccacuacaaccagcagcccgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugagcaacagcagauuccccgugcccaucgacgagcuguacaccagccccaacgagggcgugguggugcagccccagaacggcagaagcacccuggacggcgagcugcugggcaccacccagcuggugcccagcaacaucugcgcccugagaggcagaaucaacgcccaggugcccgacgaccaccaccaguggaaccugcaggugaccaacaccaacggcacccccuucgaccccaccgaggacgugcccgccccccugggcacccccgacuuccuggccaacaucuacggcgugaccagccagagaaaccccaacaacaccugcagagcccacgacggcgugcuggccaccuggagccccaaguucacccccaagcugggcagcguggugcugggcaccugggaggagagcgaccuggaccugaaccagcccaccagauucacccccgugggccuguucaacaccgaccacuucgaccagugggugcugcccaacuacagcggcagacugacccugaacaugaaccuggcccccagcgugagcccccuguuccccggcgagcagauccuguucuucagaagccacaucccccugaagggcggcaccagcgacggcgccaucgacugccugcugccccaggaguggauccagcacuucuaccaggagagcgcccccagccccaccgacguggcccugaucagauacaccaaccccgacaccggcagagugcuguucgaggccaagcugcacagacagggcuucaucaccguggccaacagcggcagcagacccaucguggugccccccaacggcuacuucagauucgacagcugggugaaccaguucuacagccuggcccccaugggcaccggcaacggcagaagaagagugcaguga

SEQ ID NO: 26086 - RNA, 1608 nt, Artificial Sequence
  derived and/or modified sequence opt4 from VP1__Norovirus_and/or_Norovirus-like__KP064099
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgacaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccgacagcgccaaguucacccccaagcugggcgccauccagaucggcaccugggaggaggacgacgugcacaucaaccagcccaccaaguucacccccgugggccuguucgagagagagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 26087 - RNA, 1608 nt, Artificial Sequence
  derived and/or modified sequence opt4 from VP1__Norovirus_and/or_Norovirus-like__AB303926
augaagauggccagcaacgacgccacccccagcgacggcagcaccgccaaccuggugcccgaggugaacaacgaggugauggcccuggagcccguggugggcgccgccaucgccgccagaguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagauga

SEQ ID NO: 26088 - RNA, 1608 nt, Artificial Sequence
  derived and/or modified sequence opt4 from VP1__Norovirus_and/or_Norovirus-like__KU985166
augaagauggccagcagcgacgccaaccccagcgacggcagcaccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcggcaucaccagaaucggccagagcgagagcuacaagaugaaccuggccagccagaacuggaacaacuacgaccccaccgaggagauccccgccccccugggcacccccgacuucaagggcagaaucagaggccugcugacccagaccaccaagggcgccggcagcaccagaggccacaaggccaccgugcugaccggcggcagcgacuucacccccaagcugggcaccgugagauucgacaccaagagcaucgacuucgagaacaaccagaacaccaaguucacccccgugggcguggugcaggacggcaacaaccacgacgagcccacccagugggugcugcccaacuacagcggccccgacacccacaacgugcaccuggcccccgccguggcccccaccuuccccggcgagcagcugcuguucuucagaagcaccaugcccggcugcagcggcuaccccaagauggagcuggacugccugcugccccaggagugggugcagcacuucuaccaggaggccgcccccgcccagaccgacguggcccugcugagauucgugaaccccgacaccggcagagugcuguucgagugcaagcugcacaagagcggcuacgugaccguggcccacaccggcgaccacgaccuggugaucccccccaacggcuacuucagauucgacagcugggugaaccaguucuacacccuggcccccaugggcaacggcaccggcagaagaagauga

SEQ ID NO: 26089 - RNA, 1608 nt, Artificial Sequence
  derived and/or modified sequence opt4 from VP1__Norovirus_and/or_Norovirus-like__JN699045
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacgugccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacagcggcgacaucaucggcagccugggcuggaucagcgcccccagcgacagcagccagcugaacguguggaccauccccaaguacggcagcagccugcccgacgugacccaccuggcccccgccguguucccccccggcuucggcgaggugauccuguacuuccacagcaccuuccccggcagcggccagcccggccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26090 - RNA, 1608 nt, Artificial Sequence
  derived and/or modified sequence opt4 from VP1__Norovirus_and/or_Norovirus-like__EF547395
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacgugccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcagccccuucaucccccuggagagccccgcccccgugggcuuccccgaccugggcggcugcgacuggcacgugaacuucaccuuccaggcccaggaccaggaccccagccagagcgugaccuucgccaccaacgacgccagcuucgugcccuaccugggcagcaucagcccccacaacggcggcgacuuccacagcggcgacaucaucggcagccugggcuggaucagcgcccccagcgacagcagccagcugaacguguggaccauccccaaguacggcagcagccugcccgacgugacccaccuggcccccgccguguucccccccggcuucggcgaggugauccuguacuucuacagcaccuuccccggcagcggccagcccggccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcguggccagaagacuguga

SEQ ID NO: 26091 - RNA, 1608 nt, Artificial Sequence
  derived and/or modified sequence opt4 from VP1__Norovirus_and/or_Norovirus-like__AY502008
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacgugccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcagccccuucaucccccuggagagccccgcccccgugggcuuccccgaccugggcggcugcgacuggcacgugaacuucaccuuccaggcccaggaccaggaccccagccagagcgugaccuucgccaccaacgacgccagcuucgugcccuaccugggcagcaucagcccccacaacggcggcgacuuccacagcggcgacaucaucggcagccugggcuggaucagcgcccccagcgacagcagccagcugaacguguggaccauccccaaguacggcagcagccugcccgacgugacccaccuggcccccgccguguucccccccggcuucggcgaggugauccuguacuucuacagcaccuuccccggcagcggccagcccgugcagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcguggccagaagacuguga

SEQ ID NO: 26092 - RNA, 1608 nt, Artificial Sequence
  derived and/or modified sequence opt4 from VP1__Norovirus_and/or_Norovirus-like__AY502007
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucgugccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacacccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26093 - RNA, 1608 nt, Artificial Sequence
  derived and/or modified sequence opt4 from VP1__Norovirus_and/or_Norovirus-like__KC998959
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccaggaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcggcaacagccagcugaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26094 - RNA, 1608 nt, Artificial Sequence
  derived and/or modified sequence opt4 from VP1__Norovirus_and/or_Norovirus-like__GQ856464
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26095 - RNA, 1608 nt, Artificial Sequence
  derived and/or modified sequence opt4 from VP1__Norovirus_and/or_Norovirus-like__GQ856463
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugguggaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26096 - RNA, 1608 nt, Artificial Sequence
  derived and/or modified sequence opt4 from VP1__Norovirus_and/or_Norovirus-like__KM036372
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucgugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26097 - RNA, 1608 nt, Artificial Sequence
  derived and/or modified sequence opt4 from VP1__Norovirus_and/or_Norovirus-like__AF538678
augaagauggccagcaaggacgccccccccagccccgacggcgccagcggcgccggccagcuggugcccgaggugaacaccgccgaccagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccacccugauccagggcauguucgugagccccgacgugaaccagagcgugcaguuccagaacggcagaugccagaucgacggccagcugcagggcaccacccccgugagccugagccagcugugcaagaucagaggcaagaccagcagcaacaccagagugcugaaccugagcgagguggacggcacccccuucgugccccuggagagccccgcccccgugggcuuccccgacaucggcggcugcgacuggcacgugggcuucaccuucgaggccagagaccaggaccccagccagaacgugaccuucgccaccaacgacagcagcuucgugcccuaccugggcagcaucagcccccacaacggcgacggcuuccacagcggcgacaucgugggcagccuggacuggaucagcgcccccagcgacggcagcgcccuggacguguggagcauccccaaguacggcagcagccugcccgacgugacccaccuggcccccgugguguucccccccggcuucggcgaggugauccuguacuuccacagcaaguuccccggcagcggccccaccgacaagcugagagugcccugccugaugccccaggaguucaucacccacuucugcaacgagcaggcccccaucgccggcgaggccgcccugcugcacuacguggaccccgacaccggcagaaaccugggcgaguucaagcuguacagcgacggcuucaugaccugcgugcccaacagcaucagcagcggcccccagacccugcccaucaacggcguguucguguucgugagcugggugagcagauucuaccagcugaagcccgugggcaccgccagcgccgccagaagacuguga

SEQ ID NO: 26098 - RNA, 1608 nt, Artificial Sequence
  derived and/or modified sequence opt4 from VP1__Norovirus_and/or_Norovirus-like__KC294198
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguuccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagagcagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26099 - RNA, 1608 nt, Artificial Sequence
  derived and/or modified sequence opt4 from VP1__Norovirus_and/or_Norovirus-like__KT732280
augaugauggccagcaaggacgcccccaccagccccgacggcgccagcggcgccggccagcuggugcccgaggugaacaccgccgaccagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccacaugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccacccugauccagggcauguucgugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucgugccccuggagagccccgcccccgugggcuuccccgaccugggcggcugcgacuggcacgugggcuucaccuucgaggccagagaccaggaccccagccagaacgugaccuucgccaccaacgacagcagcuucgugcccuaccugggcagcaucagcccccacaacggcgacggcuuccacagcggcgacaucaucggcagccuggacuggaucagcgcccccagcgacggcagcacccuggacguguggagcauccccaaguacggcagcagccugcccgacgugacccaccuggcccccgccguguucccccccggcuucggcgaggugauccuguacuuccacagcaaguuccccggcagcggccccaccgacaagcugagagugcccugccugaucccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcaucagcagcggcccccagacccugcccaccaacggcguguucguguucgugagcugggugagcagauucuaccagcugaagcccgugggcaccgccagcauggccagaagacuguga

SEQ ID NO: 26100 - RNA, 1608 nt, Artificial Sequence
  derived and/or modified sequence opt4 from VP1__Norovirus_and/or_Norovirus-like__LC101822
augaugauggccagcaaggacgugcccaccagccccgacggcgccagcggcgccggccagcuggugcccgaggugaacaccgccgaccagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccacccugauccagggcauguucgugagccccgacgugaaccagagcgugcaguuccagaacggcagaugccagaucgacggccagcugcagggcaccacccccgugagccugagccagcugugcaagaucagaggcaagaccagcagcaacaccagagugcugaaccugagcgagguggacggcacccccuucgugccccuggagagccccgcccccgugggcuuccccgacaucggcggcugcgacuggcacgugggcuucaccuucgaggccagagaccagggccccagccagaacgugaccuucgccaccaacgacagcagcuucgugcccuaccugggcagcaucagcccccacaacggcgacggcuuccacagcggcgacaucaucggcagccuggacuggaucagcgcccccagcgacggcagcgcccuggacguguggagcauccccaaguacggcagcagccugcccgacgugacccaccuggcccccgccguguucccccccggcuucggcgaggugauccuguacuuccacagcaaguuccccggcagcggccccaccgacaagcugagagugcccugccugaugccccaggaguucaucacccacuucugcgacgagcaggcccccaucgccggcgaggccgcccugcugcacuacguggaccccgacgccggcagaaaccugggcgaguucaagcuguaccccgacggcuucaugaccugcgugcccaacagcaucagcagcggcccccagacccugcccaucaacggcguguucguguucgugagcugggugagcagauucuaccagcugaagcccgugggcaccgccagcauggccagaagacuguga

SEQ ID NO: 26101 - RNA, 1608 nt, Artificial Sequence
  derived and/or modified sequence opt4 from VP1__Norovirus_and/or_Norovirus-like__KP407451
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucagcuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26102 - RNA, 1608 nt, Artificial Sequence
  derived and/or modified sequence opt4 from VP1__Norovirus_and/or_Norovirus-like__LN854564
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26103 - RNA, 1608 nt, Artificial Sequence
  derived and/or modified sequence opt4 from VP1__Norovirus_and/or_Norovirus-like__JQ388274
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26104 - RNA, 1608 nt, Artificial Sequence
  derived and/or modified sequence opt4 from VP1__Norovirus_and/or_Norovirus-like__KP027330
augaugauggccagcaaggacgcccccaccagccccgacggcgccagcggcgccggccagcuggugcccgaggugaacaccgccgaccagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccacaugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccacccugauccagggcauguucgugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucgugccccuggagagccccgcccccgugggcuuccccgaccugggcggcugcgacuggcacgugggcuucaccuucgaggccagagaccaggaccccagccagaacgugaccuucgccaccaacgacagcagcuucgugcccuaccugggcagcaucagcccccacaacggcgacggcuuccacagcggcgacaucaucggcagccuggacuggaucagcgcccccagcgacggcagcacccuggacguguggagcauccccaaguacggcagcagccugcccgacgugacccaccuggcccccgccguguucccccccggcuucggcgaggugauccuguacuuccacagcaaguuccccggcagcggccccaccgacaagcugagagugcccugccugaucccccaggaguucaucacccacuucugcaacgagcaggcccccaucgccggcgaggccgcccugcugcacuacguggaccccgacaccggcagaaaccugggcgaguucaagcuguaccccgacggcuacaugaccugcgugcccaacagcaucagcagcggcccccagacccugcccaccaacggcguguucguguucgugagcugggugagcagauucuaccagcugaagcccgugggcaccgccagcauggccagaagacuguga

SEQ ID NO: 26105 - RNA, 1608 nt, Artificial Sequence
  derived and/or modified sequence opt4 from VP1__Norovirus_and/or_Norovirus-like__AF093797
augaugauggccagcaaggacgccccccccagccccgacggcgccagcggcgccggccagcuggugcccgaggugaacaccgccgaccagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaaggugaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccacccugauccagggcauguucgugagccccgacgugaaccagagcgugcaguuccagaacggcagaugccagaucgacggccagcugcagggcaccacccccgugagccugagccagcugugcaagaucagaggcagaaccagcagcaacaccagagugcugaaccugagcgagguggacggcacccccuucgugccccuggagagccccgcccccgugggcuuccccgacaucggcggcugcgacuggcacgugggcuucaccuucgaggccagagaccaggaccccagccagaacgugaccuucgccaccaacgacagcagcuucgugcccuaccugggcagcaucagcccccacaacggcgacggcuuccacagcggcgacaucaucggcagccuggacuggaucagcgcccccagcgacggcagcgcccuggacguguggagcauccccaaguacggcagcagccugcccgacgugacccaccuggcccccgccguguucccccccggcuucggcgaggugauccuguacuuccacagcaaguuccccggcagcggccccaccgacaagcugagagugcccugccugaucccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcaucagcagcggcccccagacccugcccaucaacggcguguucguguucgugagcugggugagcagauucuaccagcugaagcccgugggcaccgccagcgccgccagaagacuguga

SEQ ID NO: 26106 - RNA, 1608 nt, Artificial Sequence
  derived and/or modified sequence opt4 from VP1__Norovirus_and/or_Norovirus-like__AB810006
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccccuucagauucgacagcugggugaaccaguucuacagccuggcccccaugggcaccggcuga

SEQ ID NO: 26107 - RNA, 1605 nt, Artificial Sequence
  derived and/or modified sequence opt4 from VP1__Norovirus_and/or_Norovirus-like__LC101825
augaugauggccagcaaggacgccacccccagcgccgacggcgccaacggcgccggccagcuggugcccgaggugaacaacgccgagccccugccccuggaccccguggccggcgccagcaccgcccuggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagagugauccuggccggcaacgccuucaccgccggcaaggugaucaucugcugcgugccccccggcuuccagagcagaacccugagcaucgcccaggccacccuguucccccacgugaucgccgacgugagaacccuggagccccuggagaucccccuggaggacgugagaaacacccuguaccacaacaacgacagccagcccaccaugagacugcugugcaugcuguacaccccccugagaaccggcggcggcagcggcggcaccgacgccuucgugguggccggcagagugcugaccugccccagccccgacuucaacuuccuguuccuggugccccccaccguggagcagaagaccagacccuucagcgugcccaacaucccccugcagaaccugagcaacagcagagugcccagccugauccagagcauggugcugagcagcgaccacgcccagaccgugcaguuccagaacggcagaugcaccaccgacggccaccugcugggcaccacccccgugagcagcggccagcugaugaaguucagaggcaaggugacccccggcagcaaggugcugaaccugaccgagcuggacggcagccccuuccuggccuucgagccccccgcccccgccggcuuccccgaccugggcaagugcgacuggcacaucgagaugagccuguaccaggugaacaaccaggacaaccccaucgugcugagagccaucgagcccaacagcagcagcuucgugccccaccugggcagcgugagcuucaaccagaacguggacgccgccggcgacuacgugugcaccauccaguacaccagcccccccagcaacagccacgacgccgacguggacuucuggagcauccccgacuacggcagcaaccuggccgaggccagccagcuggcccccgugguguacccccccggcuucggcgaggccaucguguacuucaugagcagagugcccggcuggaacagaaccaacagacugaaccuggugcccugccugcugccccaggaguucaucggccacuucgugagcgagcaggcccccgccaucggcgaggccgcccugcugcacuacguggaccccgacaccaacagaaaccugggcgaguucaagcuguaccccgagggcuucaucaccugcgugcccaacggcaccggcccccagcagcugccccugaacggcguguucguguucagcagcugggugagcagauucuaccagcugaagcccgugggcaccgccagcagcgccagauga

SEQ ID NO: 26108 - RNA, 1605 nt, Artificial Sequence
  derived and/or modified sequence opt4 from VP1__Norovirus_and/or_Norovirus-like__AB081723
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacacccagcugaacguguggaccauccccaaguacggcagcagccugcagaugagccugacccugcaccugcugugcagccccagacugugggaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26109 - RNA, 1605 nt, Artificial Sequence
  derived and/or modified sequence opt4 from VP1__Norovirus_and/or_Norovirus-like__JN005886
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugcaccugggcccccaccugaaccccuuccugcagcaccugagccagauguacaacggcugggugggcaacaugagagugagagugaugcuggccggcaacgccuucaccgccggcaagaucaucaucugcugcgugccccccggcuucgccagccagaacaucagcaucggccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccagccccgacuucaacuuccuguuccuggugccccccagcguggagcagaagaccagacagcugaccgugcccaacaucccccugaacaaccuggccaacagcagagugcccgccaugaucaacaagaugaccgugagcaccgaccagaaccagguggugcaguuccagaacggcagaugcacccuggagggccagcugcugggcaccacccccgugagcgccagccagguggccagaaucagaggcaagguguucagcaccgccagcggcaagggccugaaccugaccgagcuggacggcacccccuaccacgccuucgagagccccgccccccugggcuuccccgacaucggcgccugcgacuggcacgugagcaccuucaagguggaccagaaccugagcggcgaccccaugagcagacuggacgugaagcagaacgcccccuucgccccccaccugggcagcaucgaguucaccagcgaccaggaccccaccggcgaccagcugggcacccuggccugggugagccccagcaccagcggcgccagaguggaccccuggaagauccccagcuacggcagcaccgugaccgagagcacccaccuggccccccccaucuucccccccggcuucggcgaggccaucguguacuucaugagcgacuuccccaucgugagcggcaacaccgcccaggugcccugcacccugccccaggaguucgugagccacuucguggagcagcaggcccccgugagaggcgaggccgcccugcugcacuacguggaccccgacacccacagaaaccugggcgaguucaagcuguaccccgacggcuucaucaccugcgugcccaacaccggcggcggcccccagaaccugcccaccaacggcguguucguguucagcagcugggugagcagauacuaccagcugaagcccgugggcaccgccggccccgccagaagacuguga

SEQ ID NO: 26110 - RNA, 1605 nt, Artificial Sequence
  derived and/or modified sequence opt4 from VP1__Norovirus_and/or_Norovirus-like__AB758449
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugcagcugggcccccaccugaaccccuuccugcagcaccugagccagauguacaacggcugggugggcaacaugagagugagagugaugcuggccggcaacgccuucaccgccggcaagaucaucaucugcugcgugccccccggcuucgccagccagaacaucagcaucggccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccagccccgacuucaacuuccuguuccuggugccccccagcguggagcagaagaccagacagcugaccgugcccaacaucccccugaacaaccuggccaacagcagagugcccgccaugaucaacaagaugaccgugagcaccgaccagaaccagguggugcaguuccagaacggcagaugcacccuggagggccagcugcugggcaccacccccgugagcgccagccagguggccagaaucagaggcaagguguucagcaccgccagcggcaagggccugaaccugaccgagcuggacggcacccccuaccacgccuucgagagccccgccccccugggcuuccccgacaucggcgccugcgacuggcacgugagcaccuucaagguggaccagaaccugagcggcgaccccaugagcagacuggacaucaagcagaacgcccccuucgccccccaccugggcagcaucgaguucaccagcgaccaggagcccaccggcgaccagcugggcacccuggccugggugagccccagcaccagcggcgccagaguggaccccuggaagauccccagcuacggcagcaccgugaccgagagcacccaccuggccccccccaucuucccccccggcuucggcgaggccaucguguacuucaugagcgacuuccccaucgugagcggcaacaccgcccaggugcccugcacccugccccaggaguucgugagccacuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccaucaacggcguguucguguucagcagcugggugagcagauacuaccagcugaagcccgugggcaccgccggccccgccagaagacuguga

SEQ ID NO: 26111 - RNA, 1605 nt, Artificial Sequence
  derived and/or modified sequence opt4 from VP1__Norovirus_and/or_Norovirus-like__KX907729
augaugauggccagcaaggacgcccccagcaacauggacggcaccagcggcgccggccagcuggugcccgaggugaacgccgccgagccccugccccuggagcccguggugggcgccgccaccgccguggccaccgccggccaggugaaccugaucgaccccuggaucaugaacaacuucgugcaggcccccgagggcgaguucaccaucagccccaacaacacccccggcgacauccuguucgaccugcagcugggcccccaccugaaccccuuccugcagcaccugagccagauguacaacggcugggugggcaacaugagagugagagugaugcuggccggcaacgccuucaccgccggcaagaucaucaucugcugcgugccccccggcuucgccagccagaacaucagcaucggccaggccaccauguucccccacgugaucgccgacgugagagugcuggagcccaucgagaucccccuggacgacgugagaaacgugcuguuccacaccaacgagagcagacccaccaugagacugcugugcaugcuguacaccccccugagagccggcggcgccagcagcggcaccgaccccuucgugaucgccggcagagugcugaccugccccagccccgacuucaacuuccuguuccuggugccccccagcguggagcagaagaccagacagcugaccgugcccaacaucccccugaacaaccuggccaacagcagagugcccgccaugaucaacaagaugaccgugagcaccgaccagagccagguggugcaguuccagaacggcagaugcacccuggagggccagcugcugggcaccacccccgugagcgccagccagguggccagaaucagaggcaagguguucagcaccgccagcggcaagggccugaaccugaccgagcuggacggcacccccuaccacgccuucgagagccccgccccccugggcuuccccgacaucggcgccugcgacuggcacgugagcaccuucaagguggaccagaaccugagcggcgaccccaugagcagacuggacaucaagcagaacgcccccuucgccccccaccugggcagcaucgaguucaccagcgaccaggagcccaccggcgaccagcugggcacccuggccugggugagccccagcaccagcggcgccagaguggaccccuggaagauccccagcuacggcagcaccgugaccgagagcacccaccuggccccccccaucuucccccccggcuucggcgaggccaucguguacuucaugagcgacuuccccaucgugagcggcaacaccgcccaggugcccugcacccugccccaggaguucgugagccacuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccaucaacggcguguucguguucagcagcugggugagcagauacuaccagcugaagcccgugggcaccgccggccccgccagaagacuguga

SEQ ID NO: 26112 - RNA, 1602 nt, Artificial Sequence
  derived and/or modified sequence opt4 from VP1__Norovirus_and/or_Norovirus-like__JN899243
augaugauggccagcaaggacgcccccagcaacauggacggcaccagcggcgccggccagcuggugcccgaggugaacaccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugagacugggcccccaccugaaccccuuccugcugcaccugagccagauguacaacggcugggugggcaacaugagaaucagagugaugcuggccggcaacgccuucagcgccggcaagaucaucaucugcugcgugccccccggcuucgagagccagaacaucagcaucggccaggccaccauguucccccacgugaucgccgacgugagagugcuggagcccaucgagaucccccuggacgacgugagaaacgugcuguaccacaccaacgagaacagacccaccaugagacugcugugcaugcuguacaccccccugagagccggcggcgccagcagcggcaccgaccccuucgugaucgccggcagagugcugaccugccccgcccccgacuucaacuuccuguuccuggugccccccagcguggagcagaagaccagacagcugaccauccccaacaucccccugaacaaccuggccaacagcagagugcccgccaugaucaacaagauggccgugagcgccgaccagaaccagguggugcaguuccagaacggcagaugcacccuggagggccagcugcugggcaccacccccgugagcgccaaccagguggccagaaucagaggcaagguguucagcaccaacagcggcaccggccugaaccugaccgagaccgacggcacccccuaccacgccuucgagagccccgccccccugggcuuccccgacaucggcgacugcgacuggcacguguacgccuucaaggugaaccagaacaccggcgaccccauguacagacuggacaucacccagggcaacagcuucgccccccaccugggcagcaucgaguucaccagcgaccagcaccccagcggcgaccagcugggcacccugaccuggaucagcccccugaacaacgccagcagaguggaccccuggaagauccccagcuacggcagcacccugaccgagagcaccaaccuggccccccccaucuucccccccggcuucggcgaggccaucguguacuucaugagcgacuuccccaucgugagcggcaacaccacccagauccccugcacccugccccaggaguucaucagcagcuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccagcaacggcguguucaucuucagcagcugggugagcagauacuaccagcugaagcccgugggcaccgccggccccgccagaagacuguga

SEQ ID NO: 26113 - RNA, 1602 nt, Artificial Sequence
  derived and/or modified sequence opt4 from VP1__Norovirus_and/or_Norovirus-like__AB810004
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcuga

SEQ ID NO: 26114 - RNA, 1602 nt, Artificial Sequence
  derived and/or modified sequence opt4 from VP1__Norovirus_and/or_Norovirus-like__JN183163
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccuga

SEQ ID NO: 26115 - RNA, 1599 nt, Artificial Sequence
  derived and/or modified sequence opt4 from VP1__Norovirus_and/or_Norovirus-like__EU373815
augaagauggccagcaacgacgccagccccagcagcgacggcagcgccaaccuggugcccgagaucaacaacgaggugauggcccuggagcccguggccggcgccgccaucgccgcccccguggccggccagcagaacaucaucgaccccuggaucagaaacaacuucgugcaggcccccggcggcgaguucaccgugagccccagaaacgcccccggcgaggugcugcugaaccugccccugagccccgacaucaaccccuaccuggcccaccugagcagaauguacaacggcuacgccggcggcguggagguggagguggugcuggccggcaacgccuucaccgccggcaagaucaucuucgccgccgugccccccaacuucccccccgagaaccugagccccagccagaucaccaugcugccccacaucaucguggacgugagacagcuggagcccgugagaaucccccugcccgacgugagaaacaacuucuaccacuacagcagagagaacgacagcacccugagacugguggccaugcuguacaccccccugagagccaacaacgccggcgacgacguguucaccgugagcugcagagugcugaccagacccagccccgacuucgacuucaucuuccuggugccccccaccguggagagcaagagcaagcccuucaccauccccauccugaccaucgaggagaugaccaacagcagauuccccgccccccuggagaugaugaccaccggccccagccacgacaucguggugcagccccagaacggcagaugcaccaucgacggcgugcugcugggcaccacccagcugagccccgugaacaucugcagcaugagaggcgugcccaccaagagaaccaacggcaccgacaacugcuucgugcagcuggagaaccccaacggcagcgccuacgaccccaccgaggacauccccgccgugcugggcagccccgacuucgugggcgaguucuacggcaccaucacccagagaagccccaacaacagcaccagagcccaccccuucacccugaacaccggcagccccagauacacccccaagaucggcagcguggacauccacgugaccgacguggacgaccugaacgaccacgagcccgugaagcugacccccgugggccugagcggcagcagcggcagcauccaccaguggcagcugcccaacuacagcggcguggccacccacaacaugcaccuggcccccagcguggccccccuguuccccggcgagcagauccuguucuucagaagcaccgugcccggcugcggcggcuaccccaacaccaacaucgacugccugaucccccaggagugggugcagcacuucuaccaggagggcgcccccgccagaaccgacguggcccugcugagauucaucaaccccgacaccggcagagugcuguucgagugcaagcugcacaagcacggcuucaucaccguggccuacagcggcaaccacgaccuggugaugccccccaacggcuacuucagauucgagagcugggugaaccaguuccacacccuggcccccaugggcaccggcagagccgaggaguga

SEQ ID NO: 26116 - RNA, 1599 nt, Artificial Sequence
  derived and/or modified sequence opt4 from VP1__Norovirus_and/or_Norovirus-like__KC473547
auggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucagcuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcagaugagccccauccugcugcugcugugcagccccagacugugggaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacuguga

SEQ ID NO: 26117 - RNA, 1599 nt, Artificial Sequence
  derived and/or modified sequence opt4 from VP1__Norovirus_and/or_Norovirus-like__GQ266692
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcaguucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggccagcauggccaccuga

SEQ ID NO: 26118 - RNA, 1599 nt, Artificial Sequence
  derived and/or modified sequence opt4 from VP1__Norovirus_and/or_Norovirus-like__GQ266693
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccagcaccagaguguacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcguggaguucacccccaagcugggcagaauccaguucagcaccgacaccagcaacgacuucgagaccggccagaacaccagauucacccccgugggcgugauccaggacggcaacaccacccaccagaacgagccccagcagugggcccugcccaacuacagcggcagcggcagccacaacgugcaccuggcccccgccguggcccccagcuuccccggcgagcagcugcuguucuucagaagcaccaugcccggcugcagcggcuaccccaacaugaaccuggagugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcuggaucaaccaguucuacacccuggccagcauggccaccuga

SEQ ID NO: 26119 - RNA, 1599 nt, Artificial Sequence
  derived and/or modified sequence opt4 from VP1__Norovirus_and/or_Norovirus-like__EU004673
augagaaugagcgacggcgccgcccccaaggccagcggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacaucgacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccagagccggcgacaagcugaaggugaccaccuucgagaugauccugggccccaccaccaacguggaccaggcccccuaccagggcagaguguacgccagccugaccgccgccgccagccuggaccugguggacggcagagugagagccgugcccagaagcaucuacagcuuccaggacgugcugcccgaguacaacgacggccugcuggugccccuggccccccccaucggccccuuccugcccggcgaggugcugcugagauucagaaccuacaugagacagguggacagcagcgacgccgccgccgaggccaucgacugcgcccugccccaggaguucgugagcugguucgccagcaacggcuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguuccagcuggccagcgugggcagcuga

SEQ ID NO: 26120 - RNA, 1599 nt, Artificial Sequence
  derived and/or modified sequence opt4 from VP1__Norovirus_and/or_Norovirus-like__AB601769
augagaaugagcgacggcgccgcccccaaggccaacggcagcgaggccagcggccaggaccuggugcugaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgagagagccgccccccugggcuaccccgacuucagcggccagcuggagaucgaggugcagaccgagaccaccaagagaggcgagaagcugaaggugaccaccuucgagaugauccugggccccaccaccaacguggaccaggcccccuaccagggcagaguguacgccagccugagcgccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagguggacagcagcgacgccgccgccgaggccaucgacugcgcccugccccaggaguucgugagcugguucgccagcaacggcuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguaccagcuggccagcgugggcagcuga

SEQ ID NO: 26121 - RNA, 1599 nt, Artificial Sequence
  derived and/or modified sequence opt4 from VP1__Norovirus_and/or_Norovirus-like__EU004676
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgcccccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcagguggacggcacccugcugggcaccacccccgugagcggcagcugggugagcugcuucgccgccgaggccgccuacgaguuccaggccggcaccggcgagguggugaccuucaccaugaucgagcaggacggcagcgccuacgugcccggcgacagagccgccccccugggcuaccccgacuucagcggccagcuggagaucgaggugcagaccgagaccaccaagaccggcgacaagcugagagugaccaccuucgagaugauccugggccccaccaccaacguggaccaggcccccuaccagggcagagccuacgccagccugaccgccgccgccagccuggaccugguggacggcagagugagagccgugcccagaagcaucuacagcuuccaggacgagcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagcuga

SEQ ID NO: 26122 - RNA, 1599 nt, Artificial Sequence
  derived and/or modified sequence opt4 from VP1__Norovirus_and/or_Norovirus-like__JQ237823
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgcccccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcagguggacggcacccugcugggcaccacccccgugagcggcagcugggugagcugcuucgccgccgaggccgccuacgaguuccaggccggcaccggcgagguggugaccuucaccaugaucgagcaggacggcagcgccuacgugcccggcgacagagccgccccccugggcuaccccgacuucagcggccagcuggagaucgaggugcagaccgagaccaccaagaccggcgacaagcugagagugaccaccuucgagaugauccugggccccaccaccaacguggaccaggcccccuaccagggcagagccuacgccagccugaccgccgccgccagccuggaccugguggacggcagagugagagccgugcccagaagcaucuacagcuuccaggacgagcugcccgaguacaacgacggcgugcuggugccccuggcccccccccugggccccuuccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagcuga

SEQ ID NO: 26123 - RNA, 1599 nt, Artificial Sequence
  derived and/or modified sequence opt4 from VP1__Norovirus_and/or_Norovirus-like__DQ223043
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccagcgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagagccuacgccagccugaccgccgccgccagccuggaccugguggacggcagagugagagccgugcccagaagcguguacagcuuccaggacgagcugcccgaguacaacgacggccugcuggugccccuggcccccccccugggccccuuccugcccggcgaggugcugcugagauucagaaccuacaugagacagcuggacaccgccgacgccagcgcccagcccaucgacugcgcccugccccaggaguucaucagcugguucgccagcaacaacuucaccgugcagagcgacgcccugcuggugagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagcuga

SEQ ID NO: 26124 - RNA, 1599 nt, Artificial Sequence
  derived and/or modified sequence opt4 from VP1__Norovirus_and/or_Norovirus-like__JX048594
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagagcccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguaccagagcgaggugggcgagguggccaccuucacccugaucgagcaggacggcagcgccuacgugcccggcgacagagccgccccccugggcuaccccgacuacagcggccagcuggagaucgaggugcagaccgagaccaccaagaccggcgacaagcugaaggugaccaccuucgacaugauccugggccccaccaccaacguggaccaggugcccuaccagggcaagguguacgccagccugaccaccgccagcagccuggaccugguggacggcagagccagagccgugcccagaagcguguacagcuuccaggacgugcugcccgaguacaacgacggccugcuggugccccuggcccccccccugggccccuaccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagcuga

SEQ ID NO: 26125 - RNA, 1596 nt, Artificial Sequence
  derived and/or modified sequence opt4 from VP1__Norovirus_and/or_Norovirus-like__GQ266691
augaagauggccagcagcgacgccaaccccagcgacggcagcaccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccaucgaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucgagggcagcaagguguacaccaugaaccuggccagccagaacuggaacaacuacgaccccaccgaggagauccccgccccccugggcacccccgacuucaagggcagaauccagggcgugcugacccagaccaccagaagcgacggcagcaccagaggccacaccgccaccgugagcaccggcagcgccgaguucacccccaagcugggcagaauccaguucagcaccgacaccaacaacgacuucgagaccggccagaacaccaaguucacccccgugggcguggugcagaacggcagcaccacccaccagaacgagccccagcagugggagcugcccgacuacagcggcagaggcauccacaacgugcaccuggcccccgccguggcccccaccuaccccggcgagcagauccuguucuucagaagcaccaugcccggcugcagcggcuaccccaacaugaaccuggacugccugcugccccaggacugggugagacacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcuga

SEQ ID NO: 26126 - RNA, 1596 nt, Artificial Sequence
  derived and/or modified sequence opt4 from VP1__Norovirus_and/or_Norovirus-like__GQ266690
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacggccacaacgugcaccuggcccccgccguggcccccagcuuccccggcgagcagauccuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcuga

SEQ ID NO: 26127 - RNA, 1596 nt, Artificial Sequence
  derived and/or modified sequence opt4 from VP1__Norovirus_and/or_Norovirus-like__JN183164
augaugauggccagcaaggacgcccccaccaacauggacggcaccagcggcgccggccagcuggugcccgaggugagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccaaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggcccaggacagcaccuucgccccccaccugggcaccauccacuacaccaacgccgacuacaacgccaacgugggccugaucugcagccuggaguggcugagcccccccagcggcggcgcccccaaggugaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccuga

SEQ ID NO: 26128 - RNA, 1596 nt, Artificial Sequence
  derived and/or modified sequence opt4 from VP1__Norovirus_and/or_Norovirus-like__AB809995
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccuga

SEQ ID NO: 26129 - RNA, 1593 nt, Artificial Sequence
  derived and/or modified sequence opt4 from VP1__Norovirus_and/or_Norovirus-like__KT732275
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccauguga

SEQ ID NO: 26130 - RNA, 1593 nt, Artificial Sequence
  derived and/or modified sequence opt4 from VP1__Norovirus_and/or_Norovirus-like__AB809998
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgaggccaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggcagagacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggccuga

SEQ ID NO: 26131 - RNA, 1593 nt, Artificial Sequence
  derived and/or modified sequence opt4 from VP1__Norovirus_and/or_Norovirus-like__AB809984
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggccuga

SEQ ID NO: 26132 - RNA, 1590 nt, Artificial Sequence
  derived and/or modified sequence opt4 from VP1__Norovirus_and/or_Norovirus-like__KT732276
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccuga

SEQ ID NO: 26133 - RNA, 1590 nt, Artificial Sequence
  derived and/or modified sequence opt4 from VP1__Norovirus_and/or_Norovirus-like__AB810009
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuguga

SEQ ID NO: 26134 - RNA, 1590 nt, Artificial Sequence
  derived and/or modified sequence opt4 from VP1__Norovirus_and/or_Norovirus-like__KM461690
augaagauggccagcagcgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggcagacugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaacuga

SEQ ID NO: 26135 - RNA, 1587 nt, Artificial Sequence
  derived and/or modified sequence opt4 from VP1__Norovirus_and/or_Norovirus-like__JN400618
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccagauucgagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacggccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 26136 - RNA, 1587 nt, Artificial Sequence
  derived and/or modified sequence opt4 from VP1__Norovirus_and/or_Norovirus-like__JQ653095
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccacaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcccaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggagcaggacgacgugcacaucaaccagcccaccaaguucacccccgugggccuguucgagagcgagggcuucaaccaguggacccugcccaacuacagcggcgcccugacccccaacaugggccuggccccccccguggcccccaccuuccccggcgagcagauccuguucuucagaagccacaucccccugaagggcggcguggccgaccccgugaucgacugccuggugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccgugggcaccggcuga

SEQ ID NO: 26137 - RNA, 1587 nt, Artificial Sequence
  derived and/or modified sequence opt4 from VP1__Norovirus_and/or_Norovirus-like__JN183161
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugcaccugggcccccaccugaaccccuuccugcagcaccugagccagauguacaacggcugggugggcaacaugagagugagagugaugcuggccggcaacgccuucaccgccggcaagaucaucaucugcugcgugccccccggcuucgccagccagaacaucagcaucggccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccgcccccgacuucaacuuccuguuccuggugccccccagcguggagcagaagaccagacagcugaccgugcccaacaucccccugaacaacauggccaacagcagagugcccgccaugaucaacaagaugaccgugagcagcgaccagaaccagguggugcaguuccagaacggcagaugcacccuggagggccagcugcugggcaccacccccgugagcgccagccagguggccagaaucagaggcaagguguucagcaccgccagcggcaagggccugaaccugaccgagcuggacggcacccccuaccacgccuucgagagccccgccccccugggcuuccccgacaucggcgccugcgacuggcacgugagcaccuucaagguggaccagaaccugagcggcgaccccaugagcagacuggacaucaagcagaacgcccccuucgccccccaccugggcagcaucgaguucaccagcgaccaggaccccaccggcgaccagcugggcacccuggccugggugagccccagcaccagcggcaccagaguggaccccuggaagauccccagcuacggcagcaccgugaccgagagcacccaccuggccccccccaucuucccccccggcuucggcgaggccaucguguacuucaugagcgacuuccccaucgugagcggcaacaccgcccaggugcccugcacccugccccaggaguucgugagccacuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccaccaacggcguguucguguucagcagcugggugagcagauacuaccagcugaagcccgugggcaccgccuga

SEQ ID NO: 26138 - RNA, 1587 nt, Artificial Sequence
  derived and/or modified sequence opt4 from VP1__Norovirus_and/or_Norovirus-like__KT906670
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggccuga

SEQ ID NO: 26139 - RNA, 1587 nt, Artificial Sequence
  derived and/or modified sequence opt4 from VP1__Norovirus_and/or_Norovirus-like__KT906671
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggccuga

SEQ ID NO: 26140 - RNA, 1587 nt, Artificial Sequence
  derived and/or modified sequence opt4 from VP1__Norovirus_and/or_Norovirus-like__AB810013
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagcuga

SEQ ID NO: 26141 - RNA, 1584 nt, Artificial Sequence
  derived and/or modified sequence opt4 from VP1__Norovirus_and/or_Norovirus-like__EU096510
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgcccaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuguga

SEQ ID NO: 26142 - RNA, 1584 nt, Artificial Sequence
  derived and/or modified sequence opt4 from VP1__Norovirus_and/or_Norovirus-like__EU096513
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuguga

SEQ ID NO: 26143 - RNA, 1584 nt, Artificial Sequence
  derived and/or modified sequence opt4 from VP1__Norovirus_and/or_Norovirus-like__EU096514
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuguga

SEQ ID NO: 26144 - RNA, 1584 nt, Artificial Sequence
  derived and/or modified sequence opt4 from VP1__Norovirus_and/or_Norovirus-like__EU096512
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuguga

SEQ ID NO: 26145 - RNA, 1581 nt, Artificial Sequence
  derived and/or modified sequence opt4 from VP1__Norovirus_and/or_Norovirus-like__KU311161
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaacaugaucgaccccuggaucaugaacaacuucgugcaggcccccgagggcgaguucaccaucagccccaacaacacccccggcgacauccuguucgaccugagacugggcccccaccugaaccccuuccugcugcaccugagccagauguacaacggcugggugggcaacaugagagugagagugaugcuggccggcaacgccuucagcgccggcaagaucaucaucugcugcgugccccccggcuucgagagccagaacaucagcaucggccaggccaccauguucccccacgugaucgccgacgugagagugcuggagcccaucgaggugccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccgcccccgacuucaacuuccuguuccuggugccccccagcguggagcagaagaccagacagcugaccauccccaacaucccccugaacaaccuggccaacagcagagugcccgccaugaucaacaagaugaccgugagcgccgaccagaaccagguggugcaguuccagaacggcagaugcacccuggagggccagcugcugggcaccacccccgugagcgccaaccagguggccagaaucagaggcaagguguucagcaccaacagcggcaccggccugaaccugaccgagguggacggcacccccuaccacgccuucgagagccccgccccccugggcuuccccgacaucggcaacugcgacuggcacguguacgccuucaaggugaaccagaacaccggcgaccccauguacagacuggacaucacccagggcaacagcuucgccccccaccugggcagcaucgaguucagcagcgagaaccaccccagcggcgaccagcugggcacccugaccuggaucagcccccugaacaacgccagcagaguggaccccuggaagauccccaccuacggcagcacccugaccgagagcaccaaccuggccccccccaucuucccccccggcuucggcgagagcaucguguacuucaugagcgacuuccccaucgugagcggcaacaccgcccagauccccugcacccugccccaggaguucgugagcagcuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccagcaacggcguguucguguucagcagcugggugagcagauacuaccagcugaagcccgugggcaccuga

SEQ ID NO: 26146 - RNA, 1581 nt, Artificial Sequence
  derived and/or modified sequence opt4 from VP1__Norovirus_and/or_Norovirus-like__KX907730
augaugauggccagcaaggacgcccccagcaacauggacggcaccagcggcgccggccagcuggugcccgaggugaacgccgccgagccccugccccuggagcccguggugggcgccgccaccgccguggccaccgccggccaggugaacaugaucgaccccuggaucaugaacaacuucgugcaggcccccgagggcgaguucaccaucagccccaacaacacccccggcgacauccuguucgaccugagacugggcccccaccugaaccccuuccugcugcaccugagccagauguacaacggcugggugggcaacaugagagugagagugaugcuggccggcaacgccuucagcgccggcaagaucaucaucugcugcgugccccccggcuucgagagccagaacaucagcaucggccaggccaccauguucccccacgugaucgccgacgugagagugcuggagcccaucgaggugccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccgcccccgacuucaacuuccuguuccuggugccccccagcguggagcagaagaccagacagcugaccauccccaacaucccccugaacaaccuggccaacagcagagugcccgccaugaucaacaagaugaccgugagcgccgaccagaaccagguggugcaguuccagaacggcagaugcacccuggagggccagcugcugggcaccacccccgugagcgccaaccagguggccagaaucagaggcaagguguucagcaccaacagcggcaccggccugaaccugaccgagguggacggcacccccuaccacgccuucgagagccccgccccccugggcuuccccgacaucggcaacugcgacuggcacguguacgccuucaaggugaaccagaacaccggcgaccccauguacagacuggacaucacccagggcaacagcuucgccccccaccugggcagcaucgaguucagcagcgagaaccaccccagcggcgaccagcugggcacccugaccuggaucagcccccugaacaacgccagcagaguggaccccuggaagauccccaccuacggcagcacccugaccgagagcaccaaccuggccccccccaucuucccccccggcuucggcgaggccaucguguacuucaugagcgacuuccccaucgugagcggcaacaccgcccagauccccugcacccugccccaggaguucgugagcagcuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccagcaacggcguguucguguucagcagcugggugagcagauacuaccagcugaagcccgugggcaccuga

SEQ ID NO: 26147 - RNA, 1581 nt, Artificial Sequence
  derived and/or modified sequence opt4 from VP1__Norovirus_and/or_Norovirus-like__EU096507
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuguga

SEQ ID NO: 26148 - RNA, 1581 nt, Artificial Sequence
  derived and/or modified sequence opt4 from VP1__Norovirus_and/or_Norovirus-like__AB810007
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuga

SEQ ID NO: 26149 - RNA, 1581 nt, Artificial Sequence
  derived and/or modified sequence opt4 from VP1__Norovirus_and/or_Norovirus-like__AB809989
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuga

SEQ ID NO: 26150 - RNA, 1581 nt, Artificial Sequence
  derived and/or modified sequence opt4 from VP1__Norovirus_and/or_Norovirus-like__AB810000
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcguguacccccugguggugccccccaacggccacuucagauucgacagcugggugaaccaguucuga

SEQ ID NO: 26151 - RNA, 1575 nt, Artificial Sequence
  derived and/or modified sequence opt4 from VP1__Norovirus_and/or_Norovirus-like__AB809999
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagagcuucacccugcccauccugaccaucagcgagcugaccaacagcagauuccccacccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcggccugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaacuga

SEQ ID NO: 26152 - RNA, 1572 nt, Artificial Sequence
  derived and/or modified sequence opt4 from VP1__Norovirus_and/or_Norovirus-like__FJ692501
augaugauggccagcagcgacgccaccccccccagcgagggcgccaccaaccuggugcccgaggugaacacccagguggugccccuggagcccguggccggcgccgccgccgccgcccccuucaccggccagaacaacgugaucgaccccuggaucuuccagaacuucgugcaggccccccagggcgaguucaccgugagccccagaaacacccccggcgagauccugcugagaaucccccugggccccaaccugaaccccuuccuggcccaccugagcagaauguacaacgccugggugggcggcauggaggccgagaugauccuggccggcaacgccuucaccgccggcaagcugcugaucguggcccugccccccggcuucgaggccacccagcugacccccgcccaggccaccgccuucccccacgugaucgccgacgugagaacccuggagcccauccccaucccccugcccgacaucagaaacgugcuguuccacuacaacggcgaccccacccccaccauccagaucguggugaugcuguacaccccccugagaaccaacggcaacggcgacgacguguucaccgugagcggcagacugcugaccagacccgcccccgacuucagcuucagcuuccuggugccccccaccguggagcagaagaccagacccuucacccugcccaaccuggccgugagcgaccugagcaacagcagauuccccgcccccgugaacauccugagagccgaccccaacaccacccuggcccuggacuaccagaacggcagaugcacccuggacggcgcccugcagggcaccacccccaccaacagcagcuuccugggcuaccugagaggcaccguggacagagugaacagcgaccaggugcacgugcaccugagagagcccaacggcgaccccuuccagcugggccugcccggcccccagggcgugcccgacuacagagccacccuggacaucuacguggacugggagaacaagaaccacggcaaccccugcgagggcacccugaacaccggcagccagaccgaguacacccccggccugggcacccugaccuucaacaagaccagcggcgacacccccgagcagggcgaccccgugaucaugagacugguggccuucagaagcaaccugaccgaccagcugcccgccuacaacggcgccuucggccagggcgagaaccuggccccccccgugagcccccccgugcccggcgagguguuccugcaguucggcagcagauacaccagacugggcgagagagagcuggccgugcagugccugcugcccagcgaguggaucacccacuucuacagcgaggccgcccccauccagggcgaggccaugcugcugagauacgugcagcccgaccugggcagaauccuguucgaggccaagcuguacaaggagggcuucgugaccguggccggcggcaccaaccccgugaccuuccccaucgacggcaccuucguggccgugagcugggugagcagaaacuucgugcugagccccaugggcagcggccagggcagaagaagauga

SEQ ID NO: 26153 - RNA, 1572 nt, Artificial Sequence
  derived and/or modified sequence opt4 from VP1__Norovirus_and/or_Norovirus-like__FJ692500
augaugauggccagcagcgacgccaccccccccagcgagggcgccaccaaccuggugcccgaggugaacacccagguggugccccuggagcccguggccggcgccgccgccgccgcccccuucaccggccagaacaacgugaucgaccccuggaucuuccagaacuucgugcaggccccccagggcgaguucaccgugagccccagaaacacccccggcgagauccugcugagaaucccccugggccccaaccugaaccccuuccuggcccaccugagcagaauguacaacgccugggugggcggcauggaggccgagaugauccuggccggcaacgccuucaccgccggcaagcugcugaucguggcccugccccccggcuucgaggccacccagcugacccccgcccaggccaccgccuucccccacgugaucgccgacgugagaacccuggagcccauccccaucccccugcccgacaucagaaacgugcuguuccacuacaacggcgaccccacccccaccauccagaucguggugaugcuguacaccccccugagaaccaacggcaacggcgacgacguguucaccgugagcggcagacugcugaccagacccgcccccgacuucagcuucagcuuccuggugccccccaccguggagcagaagaccagaagcuucacccugcccaaccuggccgugagcgaccugagcaacagcagauuccccgcccccgugaacauccugagagccgaccccaacaccacccuggcccuggacuaccagaacggcagaugcacccuggacggcgcccugcagggcaccacccccaccaacagcagcuuccugggcuaccugagaggcaccguggacagagugaacagcgaccaggugcacgugcaccugagagagcccaacggcgaccccuuccagcugggccugcccggcccccagggcgugcccgacuacagagccacccuggacaucuacguggacugggagaacaagaaccacggcaaccccugcgagggcacccugaacaccggcagccagaccgaguacacccccggccugggcacccugaccuucaacaagaccagcggcgacacccccgagcagggcgaccccgugaucaugagacugguggccuucagaagcaaccugaccgaccagcugcccgccuacaacggcgccuucggccagggcgagaaccuggccccccccgugagcccccccgugcccggcgagguguuccugcaguucggcagcagauacaccagacugggcgagagagagcuggccgugcagugccugcugcccagcgaguggaucacccacuucuacagcgaggccgcccccauccagggcgaggccaugcugcugagauacgugcagcccgaccugggcagaauccuguucgaggccaagcuguacaaggagggcuucgugaccguggccggcggcaccaaccccgugaccuuccccaucgacggcaccuucguggccgugagcugggugagcagaaacuucgugcugagccccaugggcagcggccagggcagaagaagauga

SEQ ID NO: 26154 - RNA, 1572 nt, Artificial Sequence
  derived and/or modified sequence opt4 from VP1__Norovirus_and/or_Norovirus-like__AB031013
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcggcgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacaucggcgugcugagcugggugagcccccccagccaccccagcggcagccagguggaccuguggaagauccccaacuacggcagcagcaucaccgaggccacccaccuggcccccagcguguacccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaacccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26155 - RNA, 1572 nt, Artificial Sequence
  derived and/or modified sequence opt4 from VP1__Norovirus_and/or_Norovirus-like__KU253442
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcagcgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcagcugcagaacggcagaugcacccuggacggcagacuggugggcaccacccccgugagccugagccacguggccaagaucagaggcaccagcaacggcaccgccaucaaccugaccgagcuggacggcacccccuuccaccccuucgagggccccgcccccaucggccugcccgaccugggcggcugcgacagacacaucaacaugacccaguucggccacagcagccagacccagcacgacgccgacaccacccccgacaccagcgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26156 - RNA, 1572 nt, Artificial Sequence
  derived and/or modified sequence opt4 from VP1__Norovirus_and/or_Norovirus-like__EF547392
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcgugagcagcggcaacuacaucggcgugcugagcugggugagcccccccagccaccccagcggcagccagguggaccuguggaagauccccaacuacggcagcagcaucaccgaggccacccaccuggcccccagcguguacccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcaccgccagauga

SEQ ID NO: 26157 - RNA, 1572 nt, Artificial Sequence
  derived and/or modified sequence opt4 from VP1__Norovirus_and/or_Norovirus-like__KT943503
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26158 - RNA, 1572 nt, Artificial Sequence
  derived and/or modified sequence opt4 from VP1__Norovirus_and/or_Norovirus-like__AY502016
augaugauggccagcaaggacgccaccagcaacguggacggcgccagcggcgccggccagcuggugcccgaggccaacaccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccagagcacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccagguggccaagaucagaggcaccagcaacggcaccgugaucaaccugaccgagcuggacggcacccccuuccaccccuucgagggccccgcccccaucggcuuccccgaccugggcggcugcgacuggcacgugaacaugacccaguucggccacagcagccagacccaguucgacguggacaccacccccgagaccuucgugccccaccugggcagcauccaggccaacggcgugggcagcggcaacuacaucggcgugcugagcuggaucagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacaaccugcccugccugcugccccaggaguacaucagccacuucgccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26159 - RNA, 1572 nt, Artificial Sequence
  derived and/or modified sequence opt4 from VP1__Norovirus_and/or_Norovirus-like__KU253446
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaucggcguguucguguucgugagcugggugagcagauucuaccagcugaagcccgugggcaccgccagcagcgccagauga

SEQ ID NO: 26160 - RNA, 1572 nt, Artificial Sequence
  derived and/or modified sequence opt4 from VP1__Norovirus_and/or_Norovirus-like__KU253445
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagccuggccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26161 - RNA, 1572 nt, Artificial Sequence
  derived and/or modified sequence opt4 from VP1__Norovirus_and/or_Norovirus-like__KF039735
augaugauggccagcaaggacgccaccagcagcguggacggcgccagcggcgccggccagcuggugcccgaggugaacgccagcgacccccuggccauggaccccguggccggcagcagcaccgccguggccaccaccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26162 - RNA, 1572 nt, Artificial Sequence
  derived and/or modified sequence opt4 from VP1__Norovirus_and/or_Norovirus-like__KF039732
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgugaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26163 - RNA, 1572 nt, Artificial Sequence
  derived and/or modified sequence opt4 from VP1__Norovirus_and/or_Norovirus-like__KF039734
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucggcagcggcaacuacgugggcgugcugagcuggaucagcccccccagcagacccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26164 - RNA, 1572 nt, Artificial Sequence
  derived and/or modified sequence opt4 from VP1__Norovirus_and/or_Norovirus-like__KF039729
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcgugggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26165 - RNA, 1572 nt, Artificial Sequence
  derived and/or modified sequence opt4 from VP1__Norovirus_and/or_Norovirus-like__KF039737
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacgugaacaccacccccgacaccuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26166 - RNA, 1572 nt, Artificial Sequence
  derived and/or modified sequence opt4 from VP1__Norovirus_and/or_Norovirus-like__KF039731
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcagcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaucuucgugccccaccugggcagcauccaggccaacggcaucggcagcggcaacuacgugggcgugcugagcuggaucagcccccccagccaccccagcggcagccagguggaccuguggaagauccccaacuacggcagcagcaucaccgaggccacccaccuggcccccagcguguacccccccggcuucggcgaggugcugguguucuucaugagcaagaugcccggccccggcgccuacaaccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcagcgccagauga

SEQ ID NO: 26167 - RNA, 1563 nt, Artificial Sequence
  derived and/or modified sequence opt4 from VP1__Norovirus_and/or_Norovirus-like__KT732279
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagccuggugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucaacagcggcaacuacaucggcgugcugagcugggugagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcuga

SEQ ID NO: 26168 - RNA, 1563 nt, Artificial Sequence
  derived and/or modified sequence opt4 from VP1__Norovirus_and/or_Norovirus-like__FJ384783
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucaacagcggcaacuacaucggcgugcugagcugggugagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcuga

SEQ ID NO: 26169 - RNA, 1563 nt, Artificial Sequence
  derived and/or modified sequence opt4 from VP1__Norovirus_and/or_Norovirus-like__EU085522
augaugauggccagcaaggacgccaccagcagcguggacggcgccagcggcgccggccagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccacaaccugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagaaccggcagcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccuucgugccccaccugggcagcauccaggccaacggcaucaacagcggcaacuacaucggcgugcugagcugggugagcccccccagccaccccagcggcagccagguggaccuguggaagauccccaacuacggcagcagcaucaccgaggccacccaccuggcccccagcguguucccccccggcuucggcgaggugcugguguucuucaugagcaagauccccggccccggcgccuacagccugcccugccugcugccccaggaguacaucagccaccuggccagcgagcaggcccccaccgugggcgaggccgcccugcugcacuacguggaccccgacaccggcagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcuga

SEQ ID NO: 26170 - RNA, 1563 nt, Artificial Sequence
  derived and/or modified sequence opt4 from VP1__Norovirus_and/or_Norovirus-like__L23828
augaugauggccagcaaggacgccaccagcagcguggacggcgccagcgccagcgugcagcuggugcccgaggugaacgccagcgacccccuggccauggaccccguggccggcagcagcaccgccguggccaccgccggccaggugaaccccaucgaccccuggaucaucaacaacuucgugcaggccccccagggcgaguucaccaucagccccaacaacacccccggcgacgugcuguucgaccugagccugggcccccaccugaaccccuuccugcugcaccugagccagauguacaacggcugggugggcaacaugagagugagaaucaugcuggccggcaacgccuucaccgccggcaagaucaucgugagcugcaucccccccggcuucggcagccagcagcugaccaucgcccaggccacccuguucccccacgugaucgccgacgugagaacccuggaccccaucgaggugccccuggaggacgugagaaacgugcuguuccacaacaacgacagaaaccagcagaccaugagacuggugugcaugcuguacaccccccugagcaccggcggcggcaccggcgacagcuucgugguggccggcagagugaugaccugccccagccccgacuucaacuuccuguuccuggugccccccaccguggagcagaagaccagacccuucacccugcccaaccugccccugagcagccugagcaacagcagagccccccugcccaucagcggcaugggcaucagccccgacaacgugcagagcgugcaguuccagaacggcagaugcacccuggacggcagacuggugggcaccacccccgugagccugagccacguggccaagaucagaggcaccagcaacggcaccgugaucaaccugaccgagcuggacggcacccccuuccaccccuucgagggccccgcccccaucggcuuccccgaccugggcggcugcgacuggcacaucaacaugacccaguucggccacagcagccagacccaguacgacguggacaccacccccgacaccagcgugccccaccugggcagcauccaggccaacggcaucggcagcggcaacuacaucggcgugcugagcugggugagcccccccagccaccccagcggcagccagguggaccuguggaagauccccaacuacggcagcagcaucaccgaggccacccaccuggcccccagcguguacagccccggcuucggcgaggugcugguguucuucaugagcaagauccccggccccggcggcgacagccugcccugccugcugccccagggcuacaucagccaccuggccagcgagcaggcccccaccgugggcgagggcccccugcugcacuacguggaccccgacaccgacagaaaccugggcgaguucaaggccuaccccgacggcuuccugaccugcgugcccaacggcgccagcagcggcccccagcagcugcccaucaacggcguguucguguucgugagcugggugagcagauucuaccagcugaagcccgugggcaccgccagcuga

SEQ ID NO: 26171 - RNA, 1563 nt, Artificial Sequence
  derived and/or modified sequence opt4 from VP1__Norovirus_and/or_Norovirus-like__KX764843
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgaggugcugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacgccugguga

SEQ ID NO: 26172 - RNA, 1563 nt, Artificial Sequence
  derived and/or modified sequence opt4 from VP1__Norovirus_and/or_Norovirus-like__KX764841
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggagaaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcggcuacccccugguggugcccgccaacggccacuucagauucgagagcugguga

SEQ ID NO: 26173 - RNA, 1563 nt, Artificial Sequence
  derived and/or modified sequence opt4 from VP1__Norovirus_and/or_Norovirus-like__KX764840
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugguga

SEQ ID NO: 26174 - RNA, 1563 nt, Artificial Sequence
  derived and/or modified sequence opt4 from VP1__Norovirus_and/or_Norovirus-like__KT864687
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgagagcugguga

SEQ ID NO: 26175 - RNA, 1563 nt, Artificial Sequence
  derived and/or modified sequence opt4 from VP1__Norovirus_and/or_Norovirus-like__KX764842
augaagauggccagcaacgacguggcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacgccugguga

SEQ ID NO: 26176 - RNA, 1563 nt, Artificial Sequence
  derived and/or modified sequence opt4 from VP1__Norovirus_and/or_Norovirus-like__KT864685
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggccccgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugguga

SEQ ID NO: 26177 - RNA, 1563 nt, Artificial Sequence
  derived and/or modified sequence opt4 from VP1__Norovirus_and/or_Norovirus-like__KT864684
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgagagcugguga

SEQ ID NO: 26178 - RNA, 1563 nt, Artificial Sequence
  derived and/or modified sequence opt4 from VP1__Norovirus_and/or_Norovirus-like__KX764836
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcgugaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgaggccugguga

SEQ ID NO: 26179 - RNA, 1563 nt, Artificial Sequence
  derived and/or modified sequence opt4 from VP1__Norovirus_and/or_Norovirus-like__KX764845
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagccugcaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgaggccugguga

SEQ ID NO: 26180 - RNA, 1563 nt, Artificial Sequence
  derived and/or modified sequence opt4 from VP1__Norovirus_and/or_Norovirus-like__KX764837
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcgccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgugcccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcgugaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacgccugguga

SEQ ID NO: 26181 - RNA, 1563 nt, Artificial Sequence
  derived and/or modified sequence opt4 from VP1__Norovirus_and/or_Norovirus-like__KX764838
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugagccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagguggugcccagcggcaucugcgccuucagaggcagagugaccgcccagaucaaccagagagacagauggcacaugcagcugcagaaccugaacagcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucgccguggcccacagcggcgacuacccccugguggugcccgccaacggccacuucagauucgacagcugguga

SEQ ID NO: 26182 - RNA, 1563 nt, Artificial Sequence
  derived and/or modified sequence opt4 from VP1__Norovirus_and/or_Norovirus-like__KU687016
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcuucagagugcugaccagacccacccccgacuucgaguucaccuaccuggugccccccagcguggagagcagaaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggccaggugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcaucaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacgccugguga

SEQ ID NO: 26183 - RNA, 1563 nt, Artificial Sequence
  derived and/or modified sequence opt4 from VP1__Norovirus_and/or_Norovirus-like__KU687015
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugcugcccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacccccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacauccagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcaucaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacgccugguga

SEQ ID NO: 26184 - RNA, 1563 nt, Artificial Sequence
  derived and/or modified sequence opt4 from VP1__Norovirus_and/or_Norovirus-like__KU687013
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcggcgacguguucaccgugagcugcagagugcugaccagacccacccccgacuucgaguucaccuaccuggugccccccagcgugaagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcaucaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgagagcugguga

SEQ ID NO: 26185 - RNA, 1563 nt, Artificial Sequence
  derived and/or modified sequence opt4 from VP1__Norovirus_and/or_Norovirus-like__KX764839
augaagauggccagcagcgacgccgcccccagcaacgacggcgccgccggccuggugcccgagggcaacaacgagacccugccccuggagcccguggccggcaccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccugggccccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgaggccugguga

SEQ ID NO: 26186 - RNA, 1563 nt, Artificial Sequence
  derived and/or modified sequence opt4 from VP1__Norovirus_and/or_Norovirus-like__KX764844
augaagauggccagcaacgacgccgcccccagcaacgacggcgccgccggccuggugcccgagggcaacaacggcacccugccccuggagcccguggccggcgccgccaucgccgcccccgugaccggccagaacaacaucaucgaccccuggaucagaaucaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugggccugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgagagcugguga

SEQ ID NO: 26187 - RNA, 1563 nt, Artificial Sequence
  derived and/or modified sequence opt4 from VP1__Norovirus_and/or_Norovirus-like__KT864686
augaagauggccagcagcgacgccgcccccagcaacgacggcgccgccggccuggugcccgagggcaacaacgagacccugccccuggagcccguggugggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcgacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcggccagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgagagcugguga

SEQ ID NO: 26188 - RNA, 1563 nt, Artificial Sequence
  derived and/or modified sequence opt4 from VP1__Norovirus_and/or_Norovirus-like__KU687012
augaagauggccagcagcgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaccguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacaccgacauccuggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagagccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcacccaccccacccaggagaucgacugccugaucccccaggaguggaucagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugguga

SEQ ID NO: 26189 - RNA, 1563 nt, Artificial Sequence
  derived and/or modified sequence opt4 from VP1__Norovirus_and/or_Norovirus-like__KU687018
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccagaggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgagagcugguga

SEQ ID NO: 26190 - RNA, 1563 nt, Artificial Sequence
  derived and/or modified sequence opt4 from VP1__Norovirus_and/or_Norovirus-like__KU687021
augaagauggccagcaacgacgccacccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacaaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaucaucgccgccaccggcagcaaccccgugguggugccccccaacggcuacuucagauucgagagcugguga

SEQ ID NO: 26191 - RNA, 1563 nt, Artificial Sequence
  derived and/or modified sequence opt4 from VP1__Norovirus_and/or_Norovirus-like__KU687020
augaagauggccagcagcgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacgccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacgccugguga

SEQ ID NO: 26192 - RNA, 1563 nt, Artificial Sequence
  derived and/or modified sequence opt4 from VP1__Norovirus_and/or_Norovirus-like__KU687014
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugauccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacggccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcacccaccccacccaggagaucgacugccugaucccccaggaguggaucagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacgccugguga

SEQ ID NO: 26193 - RNA, 1563 nt, Artificial Sequence
  derived and/or modified sequence opt4 from VP1__Norovirus_and/or_Norovirus-like__KU687019
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccagcacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccgaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaccaccaucgccgccaccggcagcaaccccgugguggugccccccaacggcuacuucagauucgagagcugguga

SEQ ID NO: 26194 - RNA, 1563 nt, Artificial Sequence
  derived and/or modified sequence opt4 from VP1__Norovirus_and/or_Norovirus-like__KU687017
augaagauggccagcagcgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccgugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccaggacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacgccggcagaaccaucuucgaggccaagcugcacagacagggcuucaucaccaucgccgccaccggcagcaaccccgugguggugccccccaacggcuacuucagauucgaggccugguga

SEQ ID NO: 26195 - RNA, 1563 nt, Artificial Sequence
  derived and/or modified sequence opt4 from VP1__Norovirus_and/or_Norovirus-like__KU687024
augaagauggccagcagcgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgagagcaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcgccggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacaccgacauccuggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcacccaccccacccaggagaucgacugccugaucccccaggaguggaucagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgaggccugguga

SEQ ID NO: 26196 - RNA, 1563 nt, Artificial Sequence
  derived and/or modified sequence opt4 from VP1__Norovirus_and/or_Norovirus-like__KU687022
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccccagcagaauguacaacggcuacgccggcggcguggaggugcaggugcugcuggccggcaacgccuucaccgccggcaagauccuguucgccgccgugccccccaacuuccccguggacaugcugagccccacccagaucaccaugcugccccaccugaccguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacgugcugaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgagagcugguga

SEQ ID NO: 26197 - RNA, 1563 nt, Artificial Sequence
  derived and/or modified sequence opt4 from VP1__Norovirus_and/or_Norovirus-like__KU687023
augaagauggccagcagcgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacaccgacauccuggugcagccccagaacggcagaugcacccuggacggcgagcugcagggcaccacccagcugcugaccaccgccaucugcagcuacagaggcaccaccagcaaccccaccagcgacuacugggacggccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcacccaccccacccaggagaucgacugccugaucccccaggaguggaucagccacuucuaccaggagagcgcccccagccagagcgacguggcccuggugagauacgugaaccccgacaccggcagaaccaucuucgaggccaagcugcacagacagggcuucaucgccaucgccgccaccggcagcaaccccgugguggugccccccaacggcuacuucagauucgaggccugguga

SEQ ID NO: 26198 - RNA, 1563 nt, Artificial Sequence
  derived and/or modified sequence opt4 from VP1__Norovirus_and/or_Norovirus-like__KX764847
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagcaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgaggccugguga

SEQ ID NO: 26199 - RNA, 1563 nt, Artificial Sequence
  derived and/or modified sequence opt4 from VP1__Norovirus_and/or_Norovirus-like__KX764846
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacccccccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacgccugguga

SEQ ID NO: 26200 - RNA, 1563 nt, Artificial Sequence
  derived and/or modified sequence opt4 from VP1__Norovirus_and/or_Norovirus-like__KX764833
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacagagccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacgccugguga

SEQ ID NO: 26201 - RNA, 1563 nt, Artificial Sequence
  derived and/or modified sequence opt4 from VP1__Norovirus_and/or_Norovirus-like__KX764834
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcuggacaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugguga

SEQ ID NO: 26202 - RNA, 1563 nt, Artificial Sequence
  derived and/or modified sequence opt4 from VP1__Norovirus_and/or_Norovirus-like__KU687027
augaagauggccagcaacgacgccaaccccagcgacggcagcgccgccaaccuggugcccgaggugaacaacgaggugauggcccuggagcccguggugggcgccgccaucgccgcccugguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccauccagcugagccccgugaacaucugcaccuucagaggcgacgugacccacaucaccggcagcagaaacuacaccaugaaccuggccagccagaacuggaacgacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccacccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgagagcugguga

SEQ ID NO: 26203 - RNA, 1563 nt, Artificial Sequence
  derived and/or modified sequence opt4 from VP1__Norovirus_and/or_Norovirus-like__KX764835
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccccagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaaguuccacaagagcggcuacgugaccguggcccacaccggccagcacgaccuggugaucccccccaacggcuacuucagauucgagagcugguga

SEQ ID NO: 26204 - RNA, 1563 nt, Artificial Sequence
  derived and/or modified sequence opt4 from VP1__Norovirus_and/or_Norovirus-like__KX764832
augaagauggccagcaacgacgugaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggcccugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccaacaccggcagagugcuguucgagugcaagcugcacaagagcggccacgugaccguggcccacaccggccagcacgaccuggugaucccccccaacggcuacuucagauucgacagcugguga

SEQ ID NO: 26205 - RNA, 1563 nt, Artificial Sequence
  derived and/or modified sequence opt4 from VP1__Norovirus_and/or_Norovirus-like__KU687025
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgaggaccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccauccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagcccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccacccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacgccggccagcacgaccuggugaucccccccaacggcuacuucagauucgaggccugguga

SEQ ID NO: 26206 - RNA, 1563 nt, Artificial Sequence
  derived and/or modified sequence opt4 from VP1__Norovirus_and/or_Norovirus-like__KU687026
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcaaggugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccauccagcugagccccgugaacaucugcaccuucagaggcgacgugacccacaucaccggcagcagaaacuacaccaugaaccuggccagccagaacuggaacaacugcgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccacccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacgccugguga

SEQ ID NO: 26207 - RNA, 1563 nt, Artificial Sequence
  derived and/or modified sequence opt4 from VP1__Norovirus_and/or_Norovirus-like__KU687028
augaagauggccagcaacgacgccaaccccagcgacggcagcgccgccaaccuggugcccgaggugaacaacgaggugauggcccuggagcccgccgugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucgccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccauccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccgugccccccaccuuccccggcgagcagcugcuguucuucagaagcaccacccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgagagcugguga

SEQ ID NO: 26208 - RNA, 1563 nt, Artificial Sequence
  derived and/or modified sequence opt4 from VP1__Norovirus_and/or_Norovirus-like__KX764831
augaagauggccagcagcgacgugaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccggcggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggccccaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgaggccugguga

SEQ ID NO: 26209 - RNA, 1560 nt, Artificial Sequence
  derived and/or modified sequence opt4 from VP1__Norovirus_and/or_Norovirus-like__JN222366
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccauccagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccagaaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcgacaacagccagcugaacguguggaccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauga

SEQ ID NO: 26210 - RNA, 1557 nt, Artificial Sequence
  derived and/or modified sequence opt4 from VP1__Norovirus_and/or_Norovirus-like__KM386679
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacuga

SEQ ID NO: 26211 - RNA, 1551 nt, Artificial Sequence
  derived and/or modified sequence opt4 from VP1__Norovirus_and/or_Norovirus-like__AY549156
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgcccccgaccaggccacccugcccguggacggcaucuucaaguucgugagcugggugagcagcuacuaccagcugagacccgugggcaacgccagcgccggcagaagacuguga

SEQ ID NO: 26212 - RNA, 1551 nt, Artificial Sequence
  derived and/or modified sequence opt4 from VP1__Norovirus_and/or_Norovirus-like__AY549163
augaagaugaccgacagagacaccaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacuacggcgccgaccccuucguggugaccggcagagugcugaccugccccagccccaacuucagcuucuucuuccuggugccccccaccguggaggagagagagacccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccauccugcccguggacggcaucuucaaguucgugagcugggugagcuucuacuaccagcugagacccgugggcaacgccagcgugggcagaagacuguga

SEQ ID NO: 26213 - RNA, 1551 nt, Artificial Sequence
  derived and/or modified sequence opt4 from VP1__Norovirus_and/or_Norovirus-like__AY549159
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagacccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacgccagaagccugcagaacuucacccccgcccugggccacaucaccuucgacgaggaggcccccgccgaccuguucagagcccaccugagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugagccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26214 - RNA, 1551 nt, Artificial Sequence
  derived and/or modified sequence opt4 from VP1__Norovirus_and/or_Norovirus-like__AY549166
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagacccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcugcuggaggccaagcugugcgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26215 - RNA, 1551 nt, Artificial Sequence
  derived and/or modified sequence opt4 from VP1__Norovirus_and/or_Norovirus-like__AF320113
augaagaugaccgacagagacaucaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugcccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaccuuccccgccagcgugcaguuccagaacggcagaugcacccugagcggcgaccugcugggcaccacccccagcagccccagcgaccugggcgccuucgugggccugaucgccgagcccggcagcagagugguggagcuguuccagcccaaccaggaggacuuccacgccggcagcgcccccgccccccugggcuuccccgacuucagcgacugcagccugaccuucgugguggccagcgccaccaccgugggcgagagaaccgugaacgccagaagccugcagaacuucacccccgcccugggccacaucaccuucgacgaggaggcccccgccgaccuguucagagcccaccugagaaaccugugggaccccaccgagcacagcuucuggagaauccccgacuacagagccgacgugcugggcagcgagcuggcccccagcgugagcgcccccggcgugggcgagacccugcuguucuucaccugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgugaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26216 - RNA, 1551 nt, Artificial Sequence
  derived and/or modified sequence opt4 from VP1__Norovirus_and/or_Norovirus-like__AY549153
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaagcagccccgccagcauccaguuccagaacggcagaugcacccugagcggcgaccugcugggcaccacccccagcagccccgccgaccugggcgccuucgugggccugagagccgagcccggcagccacgugguggagcugagccagcccaaccaggaggacuuccacgccggcagcgcccccgcccccuucggcuuccccgacuucagcgacugcagcgugaccuucgugguggccagcgccaccaucguggagcagagaaccgugaacgccagaagccugcagaacuucacccccgcccugggccacaucaccuucgacgaggaggcccccgccgaccuguucagagccagauucagaaacgugugggaccccaccgagcacagcuucuggagaauccccgacuacagagccgacgugcugggcagcgacuucgcccccagcgugagcgcccccggcgugggcgagacccugcuguucuucaugugcaacgugccccacagcaacggcgccaaccccaaccccugccccugccugcugccccaggaguggaucacccacuucgugagcgagagagccgcccugcagggcgacguggcccugcugaacuacaucaaccccaacaccggcagagugagcuucgaggccaagcuguacgccaacggcuuccugaccgugaaccugggcgccagcgacagaaccacccugcccguggacggcaucuucaaguucgugagcugggugagcuucuacuaccagcugagacccgugggcaacgccagcgugggcagaagacuguga

SEQ ID NO: 26217 - RNA, 1551 nt, Artificial Sequence
  derived and/or modified sequence opt4 from VP1__Norovirus_and/or_Norovirus-like__AY549157
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaagaacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26218 - RNA, 1551 nt, Artificial Sequence
  derived and/or modified sequence opt4 from VP1__Norovirus_and/or_Norovirus-like__AY549158
augaagaugaccgacagagacgccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccccagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcagccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26219 - RNA, 1551 nt, Artificial Sequence
  derived and/or modified sequence opt4 from VP1__Norovirus_and/or_Norovirus-like__AY549165
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacgccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccugggcccccccaccguggaggagagagagccccuguucacccugcccaaccugcccgugaacaaccugagccacagcagagugauggagcccaucgcccagaugaugagcagcagaagcuuccccgccagcgugcaguuccagaacggcagaugcacccugagcggcgaccugcugggcaccacccccagcagccccgccgaccugggcgccuucgugggccugagagccgagcccggcagccacgugguggagcugagccagcccaaccaggaggacuuccacgccggcagcgcccccgcccccuucggcuuccccgacuucagcggcugcagcgugaccuucgugguggccagcgccaccaucguggagcagagaaccgugaacaccagaagccugcagaacuucacccccgcccugggccacaucaccuucgacgaggaggcccccgccgaccuguucagagccagauucagaaacgugugggaccccaccgagcacagcuucuggagaauccccgacuacagagccgacgugcugggcagcgacuucgcccccagcgugagcgcccccggcggcggcgagacccugcuguucuucaugugcaacgugccccacagcaacggcgccaaccccaaccccugccccugccugcugccccaggaguggaucacccacuucgugagcgagagagccgcccugcagggcgacguggcccugcugaacuacaucaaccccaacaccggcagagugcuguucgaggccaagcuguacgccaacggcuuccugaccgugaaccugggcgccagcgaccaggccgcccugcccguggacggcaucuucaaguucgugagcugggugagcuucuacuaccagcugagacccgugggcaacgccagcgugggcagaagacuguga

SEQ ID NO: 26220 - RNA, 1551 nt, Artificial Sequence
  derived and/or modified sequence opt4 from VP1__Norovirus_and/or_Norovirus-like__AY549167
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccuguucacccugcccaaccugcccgugaacaaccugagccacagcagagugauggagcccaucgcccagaugaugagcagcagaggcuuccccgccagcgugcaguuccagaacggcagaugcacccugagcggcgaccugcugggcaccacccccagcagccccgccgaccugggcgccuucgugggccugagagccgagcccggcagccacgugguggagcugagccagcccaaccaggaggacuuccacgccggcagcgcccccgcccccuucggcuuccccgacuucagcgacugcagcgugaccuucgugguggccagcgccaccaucguggagcagagaaccgugaacgccagaagccugcagaacuucacccccgcccugggccacaucaccuucgacgaggaggcccccgccgaccuguucagagccagauucagaaacgugugggaccccaccgagcacagcuucuggagaauccccgacuacagagccgacgugcugggcagcgacuucgcccccagcgugagcgcccccggcgugggcgagacccugcuguucuucaugugcaacgugccccacagcagcggcgccaaccccaaccccugccccugccugcugccccaggaguggaucacccacuucgugagcgagagagccgcccugcagggcgacguggcccugcugaacuacaucaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26221 - RNA, 1551 nt, Artificial Sequence
  derived and/or modified sequence opt4 from VP1__Norovirus_and/or_Norovirus-like__AY549154
augaagaugaccgacagagacaccguggaccccgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagacacauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcagcgccgaccccuucguggugaccggcagagugcugaccugccccaaccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26222 - RNA, 1551 nt, Artificial Sequence
  derived and/or modified sequence opt4 from VP1__Norovirus_and/or_Norovirus-like__AY549155
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaguguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugaagcugaugggcaugcuguacaccccccugagagccaacagcagcgccaaccccuucguggugaccggcagagugcugaccugccccagccccaacuucagcuucuucuuccuggugccccccaccguggaggagagagagccccccuucacccugcccaaccugcccgugaacaaccugagccacagccaggugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugggcgagagaaccgugaacgccagaacccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26223 - RNA, 1551 nt, Artificial Sequence
  derived and/or modified sequence opt4 from VP1__Norovirus_and/or_Norovirus-like__AF320625
augaagaugaccgacagagacaucaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcguguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagcccagcuucacccugcccaaccugcccgugaacaaccugagccacagcagagugauggagcccaucgcccagaugaugagcagcagaaccuuccccgccagcgugcaguuccagaacggcagaugcacccugagcggcgaccugcugggcaccacccccagcagccccagcgaccugggcgccuucgugggccugaucgccgagcccggcagcagaaucguggagcugagccagcccaaccaggaggacuuccacgccggcagcgcccccgcccccuucggcuuccccgacuucagcgacugcagccugaccuucgugguggccagcgccaccaccgugggcgagagaaccgugaacgccagaagccugcagaacuucacccccgcccugggccacaucaccuucgacgaggaggcccccgccgaccuguucagagcccaccugagaaaccugugggaccccaccgagcacagcuucuggagaauccccgacuacagagccgacgugcugggcagcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26224 - RNA, 1551 nt, Artificial Sequence
  derived and/or modified sequence opt4 from VP1__Norovirus_and/or_Norovirus-like__AY274820
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccacggcgaguucaccaucagccccaacaacaaccccggcgaggugcuguucgagcugaagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccaagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgagugcagcgugaccuucaugguggccagcgccaccaccgugggcgagagaaccgugaacaccagaagccugcagaacuucacccccgcccugggccacaucaccuucgacgaggaggcccccgccgaccuguucagagccagauucagaaaccugugggagcccaccgagcacagcuucuggagaauccccgacuacagagccgacgugcugggcagcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccagccugcccguggacggcaucuucaaguucgugagcugggugagcuucuacuaccagcugagacccgugggcaacgccagcgugggcagaagacuguga

SEQ ID NO: 26225 - RNA, 1551 nt, Artificial Sequence
  derived and/or modified sequence opt4 from VP1__Norovirus_and/or_Norovirus-like__AF542083
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgaggugcuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgugggcagcgcccccgccccccugggcuuccccgacuucagcgacugcagcgugaccuucgugguggccagcgccaccaccgugggcgagagaaccgugaacaccagaagccugcagaacuucacccccgcccugggccacaucaccuucgacgaggaggcccccgccgaccuguucagagcccacuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaaccuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26226 - RNA, 1551 nt, Artificial Sequence
  derived and/or modified sequence opt4 from VP1__Norovirus_and/or_Norovirus-like__EU794907
augaagaugaccgacagagacgugaccgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccagcgaccugggcgccuucgugggccugaucgccgagcccggcagcagagugguggagcugagccagcccaaccaggaggacuuccacgccggcagcgcccccgcccccuucggcuuccccgacuucagcgacugcagccugaccuucgugguggccagcgccaccaccgugggcgagagaaccgugaacgccagaagcccccagaacuucacccccgcccugggccacaucaccuucgacgaggaggcccccgccgaccuguucagagcccaccugagaaaccugugggaccccaccgagcacagcuucuggagaauccccgacuacagagccgacgugcugggcagcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26227 - RNA, 1551 nt, Artificial Sequence
  derived and/or modified sequence opt4 from VP1__Norovirus_and/or_Norovirus-like__AY126474
augaagaugaccgacagagacaccaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugaucgccgagcccggcagcagagugguggagcugagccagcccaaccaggaggacuuccacgccggcagcgcccccgcccccuucggcuuccccgacuucagcgagugcagccugaccuucgugguggccagcgccaccaccgugggcgagagaaccgugaacaccagaagccugcagaacuucacccccgcccugggccacaucaccuucgacgaggaggcccccgccgaccuguucagagcccaccugagaaaccugugggaccccaccgagcacagcuucuggagaauccccgacuacagagccgacgugcugggcagcgaguucgcccccagcgugagcgcccccggcgugggcgagacccugcuguucuucaugugcaacgugcccagacugaacggcgccaaccccggccugugccccugccugcugccccaggaguggaucacccacuucgugagcgagagagccgcccugcagagcgacguggcccugcugaacuacgugaaccccaacaccggcagagugcuguucgagugcaagcuguacgccaacggcuuccugaccgugaaccugggcgccagcgaccaggccacccugcccguggacggcaucuucaaguucgugagcugggugagcuucuacuaccagcugagacccgugggcaacgccagcgugggcagaagacuguga

SEQ ID NO: 26228 - RNA, 1551 nt, Artificial Sequence
  derived and/or modified sequence opt4 from VP1__Norovirus_and/or_Norovirus-like__JX145650
augaagaugaccgacagagacaucguggacagcgcccccgcccugggccaggugcugccccccgagguggaggccagcgugcccguggagcccaccgccggcgcccccguggccgccagcaccgccggcagagugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggacaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacagccugagccacagcagagugauggagcccaucgcccagaugaugagcagcagaagcuuccccgccagcgugcaguuccagaacggcagaugcacccugagcggcgaccugcugggcaccacccccagcagccccgccgaccugggcgccuucgugggccugaucgccgagcccggcagcagagugguggagcugagccagcccaaccaggaggacuuccacgccggcagcgcccccgcccccuucggcuuccccgacuucagcgagugcagcgugaccuucgugguggccagcgccaccaccgugggcgagagaaccgugaacgccagaaacccccagaacuucacccccgcccugggccacaucaccuucgacgaggaggcccccgccgaccuguucagagccagauucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccauccugcccguggacggcaucuucaaguucgugagcugggugagcuucuacuaccagcugagacccgugggcaacaucagcgugggcagaagacuguga

SEQ ID NO: 26229 - RNA, 1548 nt, Artificial Sequence
  derived and/or modified sequence opt4 from VP1__Norovirus_and/or_Norovirus-like__AY549161
augaagaugaccgacagagacaccaccgacagcgcccccgcccugggccaggugcugccccccgagguggaggccagcgugcccguggagcccaccgccggcgcccccguggccgccgccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacgccagcuaccugacccccagccaggccacccaguucccccacgugcugaucgacgugagagcccccgagcccguggagaugccccuggaggacgugagaaacauccuguuccaccagggccccgacagcagaaugaagcugaugggcaugcuguacaccccccugagagccaacagcggcgccgaccccuucguggugaccggcagagugcugaccugccccagccccaacuucagcuucuucuuccuggugccccccaccguggaggagagagaggcccccuucacccugcccaaccugcccgugaacagccugagccacagcagauacgugggccccaucaugcagaugaugagcagcagaaccuuccccgccagcgugcaguuccagaacggcagaugcacccugagcggcgaccugcugggcaccacccccagcagcagcgccgaccugggcgccuucgugggccugaucgccgaggccggcagcagagugguggagcugagccagcccaaccaggaggacuuccacgccggcagcgcccccgccccccugggcuuccccgacuucagcgacugcagccugaccuucgugguggccagccugaccaccgugggcgagagaaccgugaacgccagaagccugcagaacuucacccccgcccugggccacgugaccuucgacgaggaggcccccgccgaccuguucagagccagacugagaaaccugugggaccccaccgagcacagcguguggagaauccccgacuacagagccgacgugcugggcagcgaguucgcccccagcgugagcgcccccggcgugggcgagacccugcuguucuucaugugcaacgugccccaccagaccggcgccaaccccaaccccugccccugccugcugccccaggaguggaucacccacuucgugagcgagagagccgcccugcagagcgagguggcccugcugaacuacgugaaccccaacaccggcagagugcuguucgagugcaagcuguacgccaacggcuuccugaccgugaaccugggcgccagcgaccaggugagccugcccguggacggcaucuucaaguucgugagcugggugagcuucuacuaccagcugagacccgugggcaacaccggcgugggcagaagauga

SEQ ID NO: 26230 - RNA, 1548 nt, Artificial Sequence
  derived and/or modified sequence opt4 from VP1__Norovirus_and/or_Norovirus-like__AY549164
augaagaugaccgacagagacgccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccugggcccccccaccguggaggagagagagccccuguucacccugcccaaccugcccgugaacaaccugagccacagcagagugauggagcccaucgcccagaugaugagcagcagaagcuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccaacgccaccaccgugcaggagugcaccgugaacaccagaaacccccagaacuucacccccgcccugggccacaucaccuucgacgaggaggcccccgccgaccuguucagagccagauucagaaaccugugggaccccaccgagcacagcuucuggagaauccccgacuacagagccgaggugcugggcagcgacuucgcccccagcgugagcgcccccggcgugggcgagacccugcuguucuucaugugcaacgugcccagaagcaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacaccagcgugggcagaagauga

SEQ ID NO: 26231 - RNA, 1548 nt, Artificial Sequence
  derived and/or modified sequence opt4 from VP1__Norovirus_and/or_Norovirus-like__AY126476
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaagcuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgcccccuucggcuuccccgacuucagcgacugcagcgugaccuucgugguggccagcgccaccaccgugcaggagugcaccgugaacaccagaaaccugcagaacuucacccccgcccugggccacaucaccuucgacgaggaggcccccgccgaccuguucagagccagauucagaaaccugugggaccccaccgagcacagccuguggagaauccccgacuacagagccgaggugcugggcagcgacuucgcccccagcgugagcgcccccggcgugggcgagacccugcuguucuucaugugcaacgugcccagaagcaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccagcggcuuccugaccgugaaccugggcgccagcgaccaggccacccugcccguggacggcaucuucaaguucgugagcugggugagcuucuacuaccagcugagacccgugggcaacaccagcgugggcagaagauga

SEQ ID NO: 26232 - RNA, 1548 nt, Artificial Sequence
  derived and/or modified sequence opt4 from VP1__Norovirus_and/or_Norovirus-like__EU794905
augaagaugaccgacagagacaccaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagacccccuucacccugcccaaccugcccgugaacagccugagccacagcagagccauggagcccaucgcccagaugaugagcagcagaaacuuccccgccagcgugcaguuccagaacggcagaugcacccugagcggcgaccugcugggcaccacccccagcagccccgccgacgugggcaccuucgugggccugaucgccgagcccggcagccacgugguggagcugagccagcccaaccaggaggacuuccacgccggcagcgcccccgcccccuucggcuuccccgacuucagcgacugcagccugaccuucgugguggccagcgccagcaccgugggcgagagaaccgugaacaccagaagcccccagaacuucacccccgcccugggccacaucaccuucgacgaggaggcccccgccgaccuguucagagcccaccugagaaaccugugggaccccaccgagcacagcuucuggagaauccccgacuacagagccgacgugcugggcggcgaguucgcccccagcgugagcgcccccggcgugggcgagacccugcuguucuucaugugcaacgugcccagaagcaacggcgccaaccccaaccccugccccugccugcugccccaggaguggaucacccacuucgugagcgagagagccgcccugcagagcgacguggcccugcugaacuacaucaaccccaacaccggcagagugcuguucgagugcaagcuguacgccaacggcuuccugaccgugaaccugggcgccagcgaccaggccacccugcccguggacggcaucuucaaguucgugagcugggugagcuucuacuaccagcugagacccgugggcaacaucggcgugggcagaagauga

SEQ ID NO: 26233 - RNA, 1548 nt, Artificial Sequence
  derived and/or modified sequence opt4 from VP1__Norovirus_and/or_Norovirus-like__EU794906
augaagaugaccgacagagacaccaucgacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagacccccuucacccugcccaaccugcccgugaacagccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcaccuucgugggccugaucgccgagcccggcagccacguggccgagcugagccagcccaaccaggaggacuuccacgccggcagcgcccccgcccccuucggcuuccccgacuucagcgagugcagccugaccuucgugguggccagcgccagcaccgugggcgagagaaccgugaacaccagaagccugcagaacuucacccccgcccugggccacaucaccuucgacgaggaggcccccgccgaccuguucagagcccaccugagaaaccugugggaccccaccgagcacagcuucuggagaauccccgacuacagagccgacgugcugggcggcgaguucgcccccagcgugagcgcccccggcgugggcgagacccugcuguucuucaugugcaacgugcccagacugaacggcgccaaccccaaccccugccccugccugcugccccaggaguggaucacccacuucgugagcgagagagccgcccugcagagcgacguggcccugcugaacuacaucaaccccaacaccggcagagugcuguucgagugcaagcuguacgugaacggcuuccugaccgugaaccugggcgccagcgaccaggccacccugcccguggacggcaucuucaaguucgugagcugggugagcuucuacuaccagcugagacccgugggcaacaucggcgugggcagaagauga

SEQ ID NO: 26234 - RNA, 1548 nt, Artificial Sequence
  derived and/or modified sequence opt4 from VP1__Norovirus_and/or_Norovirus-like__AY126475
augaagaugaccgacagagacaccgccgaccccgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagugcccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccccuucacccugcccaaccugcccgugaacaaccugagccacagcagagugauggagcccaucgcccagaugaugagcagcagaagcuuccccgccagcgugcaguuccagaacggcagaugcacccugagcggcgaccugcugggcaccacccccagcagccccgccgaccugggcgccuucgugggccugaucgccgagcccggcagcagagugguggagcuguuccagcccaaccaggaggacuuccacgccggcagcgcccccgcccccuucggcuuccccgacuucagcgagugcagcgugaccuucguggugagcagcgccaccaccgugggcgagagaaccgugaacgccagaaaccagcagaacuucacccccgcccugggccacaucaccuucgacgaggaggcccccgccgaccuguucagagccugcuucagaaaccugugggagcccaccgagcacagcuucuggagaauccccgacuacagagccgacgugcugggcagcgacuucgcccccagcgugagcgcccccggcgugggcgagacccugcuguucuucaugugcaacgugcccagacugaacggcgugaaccccggccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacaccagcgugggcagaagauga

SEQ ID NO: 26235 - RNA, 1548 nt, Artificial Sequence
  derived and/or modified sequence opt4 from VP1__Norovirus_and/or_Norovirus-like__AF542084
augaagaugaccgacagagacaccguggacagcgcccccgcccugggccaggugcugccccccgagguggaggccagcgugcccguggagcccaccgccggcgcccccguggccgcccccaccgccggccaggugaaccccaucgaccccuggaucuucgccaacuucgugcaggccccccagggcgaguucaccaucagccccaacaacaaccccggcgagauccuguucgagcuggagcugggccccgaccugaaccccuaccuggcccaccugagaagaauguacaacggcuggaccggcagcaugagagugagagugcugcuggccggcaacgccuucagcgccggcaagguggugguguucugcgugccccccggcuucgacaccagcuaccugacccccagccaggccacccaguucccccacgugcugaucgacgugagagcccccgagcccguggagaugccccuggaggacgugagaaacauccuguuccaccagggccccgacagcagaaugagacugaugggcaugcuguacaccccccugagagccaacagcggcgccgaccccuucguggugaccggcagagugcugaccugccccagccccaacuucagcuucuucuuccuggugccccccaccguggaggagagagagccccuguucacccugcccaaccugcccgugaacaaccugagccacagcagagugauggagcccaucgcccagaugaugagcagcagaaacuuccccgccagcgugcaguuccagaacggcagaugcacccugagcggcgaccugcugggcaccacccccagcagccccgccgaccugggcgccuucgugggccugagagccgagcccggcagcagagugguggagcugagccagcccaaccaggaggacuuccacgccggcagcgcccccgccccccugggcuuccccgacuucagcgacugcagcgugaccuucgugguggccaacgccaccaccgugcaggagugcaccgugaacaccagaaacccccagaacuucacccccgcccugggccacaucaccuucgacgaggaggcccccgccgaccuguucagagcccacuucagaaaccugugggaccccaccgagcacagcuucuggagaauccccgacuacagagccgaggugcugggcagcgacuucgcccccagcgugagcgcccccggcgugggcgagacccugcuguucuucaugugcaacgugcccagaagcaacggcgccaaccccaaccccugccccugccugcugccccaggaguggaucacccacuucgugagcgagagagccgcccugcagagcgacguggcccugcugaacuacgugaaccccaacaccggcagagugcuguucgaggccaagcuguacgccaacggcuuccugaccgugaaccugggcgccagcgaccaggccacccugcccguggacggcaucuucaaguucgugagcugggugagcuucuacuaccagcugagacccgugggcaacaccagcgugggcagaagauga

SEQ ID NO: 26236 - RNA, 1536 nt, Artificial Sequence
  derived and/or modified sequence opt4 from VP1__Norovirus_and/or_Norovirus-like__KC695807
auggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagauga

SEQ ID NO: 26237 - RNA, 807 nt, Artificial Sequence
  derived and/or modified sequence opt4 from VP2_capsid_protein__Norovirus__AGL98415
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgacgccacccacaagcugcagcagggccugaugcagaucaagcaggccgugcugcuggagggcggcuucagcgccgccgacgccgccagaggcgccaucaacgcccccaugaccaaggcccuggacuggagcggcaccagauacugggcccccgaggccagagugaccaccuacaacgccggccacuucagccccagccagcccagcagagcccccagcggcagaaucaacagcggcacccccacccccgccagaaacagccugaacagccccgccaccagcagcguggccaccagcgugcacagcaaccagaccgccagcaccagaaucggcagcagcgccggcagcggcaccagcgugagcagccugcccagcaccagcagaaccagaaacuggguggaggaccagaacagaagcgugagccccuucaugagaggcgcccugaacaccagcuucgugaccccccccagcagcagaagcagcaaccagagcaccgugagcaccgugcccaaggagauccuggacagcuggaccggcgccuucaacaccagaagacagccccuguucgcccacaucagaagaagaggcgagagcagaguguga

SEQ ID NO: 26238 - RNA, 792 nt, Artificial Sequence
  derived and/or modified sequence opt4 from VP2_capsid_protein__Norovirus__AGL98417
auggccggcgccuucuucgccggccuggccagcgacgugcugggcaccggccugggcagccugaucggcgccggcgccggcgccaucaaccagaagguggaguacgagaacaacagaaagcugcagcaggccagcuuccaguucagcagcgaccugcagcaggccagcuuccagcacgacaaggacaugcugcaggcccagaucaaggccacccagaagcugcagcacgaccugaugagagugaagcaggccgugcugcuggagggcggcuucagccccaccgacgccgccagaggcgccaucaacgcccccaugaccaaggugcuggacuggagcggcaccagauacugggcccccggcgccagagugaccaccagcaacgccggccaguucagcuucagccagcccaucagagagcccagcggcagaaccgcccccgccagaagccccgccaacagagccagcagcgugagcgcccccagcagcacccugagcaaccagaccaccagcaccagacugggcaccagcgccggcagcggcgccagcgugagcggcagcagcagcgccagcagagugagaagcuggguggagggccagaacagaagccugagccccuucauggacggcgcccugcacaccagcuucgugaccccccccagcagcaagagcagcagccagggcaccgugagcaccgugcccaaggaggugcuggacagcuggaccggcgccuucaacacccacagacagccccuguucgcccacgugagaagacagggcgagagcagaguguga

SEQ ID NO: 26239 - RNA, 648 nt, Artificial Sequence
  derived and/or modified sequence opt4 from capsid_protein_VP2__Norovirus__AFI08232
auggcccaggccgugcugggcgccaucgccgccaccgccgccggcagcgccgugggcgccggcauccaggccggcaccgaggccgcccugcagcaccagagauuccagcaggaccugacccugcagagcaacaccuucaagcacgacaaggagaugcuggccaugcagguggaggccagcaccagccugcugcagaacagccugaacaccagauacaaccugcugacccaggccggccugaccagcgccgacgccgccagagccguggccggcgcccccgugaccagagugguggacuggaacggcaccagaaucgccgccccccugagcaccgccaccacccugagaagcggcggcuucaugagcauccccgugauguacagaggcgccaagaccgagcagcagaagcugaccggcuucagcaaccccaacuacgagaccggcagcagcgugagcagaaccagccagugggugagcagccagaacagcaugagaagcagcguggcccccuuccaccccgacgcccugagaaccaccugggugaccccccccggcagcagcagcaccagcaccgugagcagcgccagcagcauccccagauucuucaacaccgagagacugccccuguucgccaacaacaagagauga

SEQ ID NO: 26240 - RNA, 807 nt, Artificial Sequence
  derived and/or modified sequence opt4 from capsid_protein_VP2__Norovirus__AFI08235
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagcuggaccggcgccuucaacaccagaagacagccccuguucgcccacaucagaagacagggcgagagcagaguguga

SEQ ID NO: 26241 - RNA, 807 nt, Artificial Sequence
  derived and/or modified sequence opt4 from capsid_protein_VP2__Norovirus__AFI08238
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcgccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcugggccggcgccuucaacaccagaagacagccccuguucgcccacaucagaagaagaggcgagagcagaguguga

SEQ ID NO: 26242 - RNA, 807 nt, Artificial Sequence
  derived and/or modified sequence opt4 from capsid_protein_VP2__Norovirus__AFI08241
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaccaaccccagaacccccacccccgccagaggcagcagcagcgccagcagcaacgccagcaccgccaccagcauccugagcaaccagaccgccagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26243 - RNA, 807 nt, Artificial Sequence
  derived and/or modified sequence opt4 from capsid_protein_VP2__Norovirus__AFI08244
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccacccacaacgccggcagauucagcaccccccagcccagcggcacccugcccggcagaaucaaccccagaacccccacccccgccagaggcagcagcaacaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26244 - RNA, 807 nt, Artificial Sequence
  derived and/or modified sequence opt4 from capsid_protein_VP2__Norovirus__AFJ38520
auggccggccccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccacccagaagcugcagcagggccugaugaaggugaagcaggccgugcugcuggagggcggcuucagcaccaccgacgccgccagaggcgccaucaacgcccccaugaccaaggcccuggacuggagcggcaccagauacugggcccccgacgccagagccaccaccuacaacgccggcagauucagcaccccccagccccugggcgcccugcccggcagaaucaaccccagagugcccgcccccgccagaagcagccccagcagccugagcaacgcccccaccgccaccagcguguacagcaaccagaccgugagcaccagacugggcagcagcgccggcagcggcgccggcgugagcagccugcccagcaccgccagaaccagaagcuggguggaggaccagaacagaaaccugagccccuucaugagaggcgcccugaacaccagcuucgugaccccccccagcagcagaagcagcaaccagggcaccgugagcaccgugcccaaggagauccuggacagcuggaccggcgccuucaacaccagaagacagccccuguucgcccacaucagaaagagaggcgagagcagaguguga

SEQ ID NO: 26245 - RNA, 765 nt, Artificial Sequence
  derived and/or modified sequence opt4 from capsid_protein_VP2__Norovirus__AFX71657
auggccggcgccuucaucgccggccuggccggcgacaugcugaccagcaccgugggcagccuggugaacgccggcgccagcgccaucaaccagaagguggacuucgagaacaacaaguaccugcagaacgccagcuucaaccacgacaaggagaugcugaacgcccagaucgaggccaccaagagacugcaggccgacaugaucgccaucaagcagggcgugcugaccgccggcggcuucagccccaccgacgccgccagaggcgccaucaacgcccccaucaccagagugcuggacuggagcggcaccagauacugggcccccaacgccaccagcaccaccagcaugagcggcggcuucaccagccagaccgugcacagaaccacccccaacuucaagaccaaccaggcccccaagagcacccccagcagcggcagcagcgugagaagcaacagcacccagcugaccagccugagcagccacagcagcggcagcagcagaagcagcggcagcaccguggugagcagccugcccagcagcaacagaaccagagacugggugaaccagcagaacuucaaccuggagccccacaugcccggcagccugagaaccgccuucgugaccccccccagcagcaccgccagcaacagcgacaccgugagcaccgugcccaagagcgugcuggacagcuggaccagcgccuucaacaccagaagacagccccuguucgcccaccugagaagaagaggcgagagcaacguguga

SEQ ID NO: 26246 - RNA, 780 nt, Artificial Sequence
  derived and/or modified sequence opt4 from capsid_protein_VP2__Norovirus__AFX71660
auggccggcgccuucguggccggccuggccggcgacgugcugagcaacggccugagcagccugaucaacgccggcgccaacgccaucaaccagagagccgaguucgacuucaaccagagacugcagcagaacagcuucaaccacgacaaggagaugcugcaggcccagauccaggccaccaagcagcugcaggccgacaugauggccaucaagcagggcgugcugaccgccggcggcuucagccccaccgacgccgccagaggcgccgugaacgcccccaugacccaggcccuggacuggaacggcaccagauacugggcccccggcagcaugagaaccaccagcuacagcggcagauucaccagcaccgcccccgccagacaggccgacuuccagcacacccagaacagacccagcagcggcagcagcgugagcagcuacaccacccagagcagcagacccacccugaccaccaccaccggcagcagccacggcaccaccagcagcaacagcaccagaagcaccaaccugagccagagcaccgugagcagagccaccagcagaaccagcgagugggugagagaccagaacagaaaccuggagcccuacaugcacggcgcccugcagaccgccuucgugaccccccccagcagcagagccagcgacggcaccgugagcaccgugcccaagggcgugcuggacagcuggacccccgccuucaacaccagaagacagccccuguucgcccaccugagaaagagaggcgagagcagaguguga

SEQ ID NO: 26247 - RNA, 780 nt, Artificial Sequence
  derived and/or modified sequence opt4 from capsid_protein_VP2__Norovirus__AFX71666
auggccggcgccuucuucgccggccuggccggcgacguggugagcaacggcaucggcagccugaucaacgccggcgccaacgccgugaaccagaagguggaguacgacuucaacaagcagcugcagauggccagcuucaagcacgacaaggagaugcugcagagccaggugcuggccaccaagcagcugcagcaggagaugaugaacaucagacagggcgugcugaccgccggcggcuucagccccgccgacgccgccagaggcgccgugaacgcccccaugaccaagauccuggacuggaacggcaccagauacugggcccccaacagcaugaagaccaccagcuacagcggccaguucagcagcagccccgugcacagaccccccgccgccccccagcacaccgccccccccaagagcaagcugcagggcgacagcgugagcguguacagcagccccagcaccgugagcagccagagcacccacagcaccgugcugagcgccggcaccggcagcagcagaagcaccagcaccagcaccgccgccagcacccugagcagaaccagcgacugggugagaggccagaacgagagacugagccccuucauggacggcgcccugcagaccaccuucgugaccccccccagcagcaaggccagcagcaacggcaccgugagcaccgugcccaaggccgugcuggacagcuggacccccaccuucaacacccacagacagccccuguucgcccaccugagaagaagaggcgagagccagaucuga

SEQ ID NO: 26248 - RNA, 807 nt, Artificial Sequence
  derived and/or modified sequence opt4 from capsid_protein_VP2__Norovirus__AFX71669
auggccggcgccuucuucgccggccuggccagcgacgugcugggcagcggccugggcagccugaucaacgccggcgccggcgugaucaaccagaagguggacuucgagaacaacagaaagcugcagcaggccagcuuccaguucagcagcaaccagcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgccagccccggcagagccaaccugagagccaccgugcccgccagaggcagcagcagcaccagcagcaacagcagcaucgccaccagcguguacagcaaccagaccaccagcaccagacugggcagcaccgccggcagcggcaccagcgugagcagccugcccagcaccgccagaaccaugagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26249 - RNA, 807 nt, Artificial Sequence
  derived and/or modified sequence opt4 from capsid_protein_VP2__Norovirus__AFX81122
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaccaaccccagaacccccacccccgccagaggcagcagcagcaccagcagcaacgccagcaccgccaccagcauccugagcaaccagaccgccagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26250 - RNA, 807 nt, Artificial Sequence
  derived and/or modified sequence opt4 from capsid_protein_VP2__Norovirus__AFX81125
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaucaugaaggccaagcaggccaugcugcuggagggcggcuucagcgagaccgacgccgccagaggcgccaucaacgcccccaugaccaaggugcuggacuggagcggcaccagauacugggcccccgacgccagaaccgccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26251 - RNA, 807 nt, Artificial Sequence
  derived and/or modified sequence opt4 from capsid_protein_VP2__Norovirus__AFX81131
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggaggugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26252 - RNA, 807 nt, Artificial Sequence
  derived and/or modified sequence opt4 from capsid_protein_VP2__Norovirus__AFX81134
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26253 - RNA, 807 nt, Artificial Sequence; identical to SEQ ID NO: 26252
  derived and/or modified sequence opt4 from capsid_protein_VP2__Norovirus__AFX81137

SEQ ID NO: 26254 - RNA, 807 nt, Artificial Sequence
  derived and/or modified sequence opt4 from capsid_protein_VP2__Norovirus__AFX81140
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcagcgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26255 - RNA, 807 nt, Artificial Sequence
  derived and/or modified sequence opt4 from capsid_protein_VP2__Norovirus__AFX81143
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaauccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26256 - RNA, 807 nt, Artificial Sequence; identical to SEQ ID NO: 26252
  derived and/or modified sequence opt4 from capsid_protein_VP2__Norovirus__AFX81149

SEQ ID NO: 26257 - RNA, 807 nt, Artificial Sequence
  derived and/or modified sequence opt4 from capsid_protein_VP2__Norovirus__AFX81152
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcagggcaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26258 - RNA, 807 nt, Artificial Sequence
  derived and/or modified sequence opt4 from capsid_protein_VP2__Norovirus__AFX81155
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugcccagccugcccagcaccgccagaaccagaagcuggguggaggaccagaacagaaaccugagccccuucaugagaggcgcccagaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26259 - RNA, 807 nt, Artificial Sequence
  derived and/or modified sequence opt4 from capsid_protein_VP2__Norovirus__AFX81158
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccugacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26260 - RNA, 807 nt, Artificial Sequence
  derived and/or modified sequence opt4 from capsid_protein_VP2__Norovirus__AFX81164
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26261 - RNA, 807 nt, Artificial Sequence; identical to SEQ ID NO: 26252
  derived and/or modified sequence opt4 from capsid_protein_VP2__Norovirus__AFX81173

SEQ ID NO: 26262 - RNA, 807 nt, Artificial Sequence; identical to SEQ ID NO: 26252
  derived and/or modified sequence opt4 from capsid_protein_VP2__Norovirus__AFX81179

SEQ ID NO: 26263 - RNA, 807 nt, Artificial Sequence; identical to SEQ ID NO: 26260
  derived and/or modified sequence opt4 from capsid_protein_VP2__Norovirus__AFX81182

SEQ ID NO: 26264 - RNA, 807 nt, Artificial Sequence
  derived and/or modified sequence opt4 from capsid_protein_VP2__Norovirus__AFX81185
auggccggcgccuucuucgccggccuggccagcgacgugcugggcagcggccugggcagccugaucaacgccggcgccggcgccaucaaccagaagguggacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26265 - RNA, 807 nt, Artificial Sequence; identical to SEQ ID NO: 26252
  derived and/or modified sequence opt4 from capsid_protein_VP2__Norovirus__AFX81188

SEQ ID NO: 26266 - RNA, 807 nt, Artificial Sequence; identical to SEQ ID NO: 26252
  derived and/or modified sequence opt4 from capsid_protein_VP2__Norovirus__AFX81191

SEQ ID NO: 26267 - RNA, 807 nt, Artificial Sequence
  derived and/or modified sequence opt4 from capsid_protein_VP2__Norovirus__AFX81194
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagagugaaccccagaacccccacccccgccagaggcagcagcagcaccagcagcaacgccagcaucgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26268 - RNA, 807 nt, Artificial Sequence; identical to SEQ ID NO: 26252
  derived and/or modified sequence opt4 from capsid_protein_VP2__Norovirus__AFX81197

SEQ ID NO: 26269 - RNA, 807 nt, Artificial Sequence
  derived and/or modified sequence opt4 from capsid_protein_VP2__Norovirus__AFX81200
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgugagcaccgccaccagcaucuaccugaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26270 - RNA, 807 nt, Artificial Sequence; identical to SEQ ID NO: 26260
  derived and/or modified sequence opt4 from capsid_protein_VP2__Norovirus__AFX81203

SEQ ID NO: 26271 - RNA, 807 nt, Artificial Sequence
  derived and/or modified sequence opt4 from capsid_protein_VP2__Norovirus__AFX81206
auggccggcgccuucuucgccggccuggccagcgacgugcugggcagcggccugagcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccgugaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26272 - RNA, 807 nt, Artificial Sequence; identical to SEQ ID NO: 26260
  derived and/or modified sequence opt4 from capsid_protein_VP2__Norovirus__AFX81209

SEQ ID NO: 26273 - RNA, 807 nt, Artificial Sequence
  derived and/or modified sequence opt4 from capsid_protein_VP2__Norovirus__AFX81212
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccaccagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26274 - RNA, 807 nt, Artificial Sequence
  derived and/or modified sequence opt4 from capsid_protein_VP2__Norovirus__AFX81215
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccgugaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgcccccaucgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26275 - RNA, 807 nt, Artificial Sequence; identical to SEQ ID NO: 26260
  derived and/or modified sequence opt4 from capsid_protein_VP2__Norovirus__AFX81218

SEQ ID NO: 26276 - RNA, 807 nt, Artificial Sequence
  derived and/or modified sequence opt4 from capsid_protein_VP2__Norovirus__AFX81221
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagccccagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26277 - RNA, 807 nt, Artificial Sequence; identical to SEQ ID NO: 26260
  derived and/or modified sequence opt4 from capsid_protein_VP2__Norovirus__AFX81224

SEQ ID NO: 26278 - RNA, 807 nt, Artificial Sequence; identical to SEQ ID NO: 26260
  derived and/or modified sequence opt4 from capsid_protein_VP2__Norovirus__AFX81227

SEQ ID NO: 26279 - RNA, 807 nt, Artificial Sequence
  derived and/or modified sequence opt4 from capsid_protein_VP2__Norovirus__AFX81230
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcgaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccgcccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26280 - RNA, 807 nt, Artificial Sequence
  derived and/or modified sequence opt4 from capsid_protein_VP2__Norovirus__AFX81233
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgugagcaccgccaccagcaucuacagcaaccagaccuucagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26281 - RNA, 807 nt, Artificial Sequence
  derived and/or modified sequence opt4 from capsid_protein_VP2__Norovirus__AFX81239
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgugagcaccgccaccagcaucuacagcaaccagaccgccagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26282 - RNA, 807 nt, Artificial Sequence
  derived and/or modified sequence opt4 from capsid_protein_VP2__Norovirus__AFX81242
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggaccggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26283 - RNA, 807 nt, Artificial Sequence
  derived and/or modified sequence opt4 from capsid_protein_VP2__Norovirus__AFX81245
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcagccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26284 - RNA, 807 nt, Artificial Sequence
  derived and/or modified sequence opt4 from capsid_protein_VP2__Norovirus__AFX81248
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccagaaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26285 - RNA, 807 nt, Artificial Sequence
  derived and/or modified sequence opt4 from capsid_protein_VP2__Norovirus__AFX81251
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcgccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26286 - RNA, 807 nt, Artificial Sequence
  derived and/or modified sequence opt4 from capsid_protein_VP2__Norovirus__AFX81254
auggccggcgccuucuucgccggccuggccagcgacgugcugggcagcggccugggcagccugaucaacgccggcgccggcgccaucaaccagaccguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggaccggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26287 - RNA, 807 nt, Artificial Sequence
  derived and/or modified sequence opt4 from capsid_protein_VP2__Norovirus__AFX81257
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcagccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccagcagcaacagcagcaucgccaccagcguguacagcaaccagaccaccagcaccagacugggcagcaccgccggcagcggcaccagcgugagcagccaccccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26288 - RNA, 807 nt, Artificial Sequence
  derived and/or modified sequence opt4 from capsid_protein_VP2__Norovirus__AFX81260
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaccagaagaagaggcgagagcagaguguga

SEQ ID NO: 26289 - RNA, 807 nt, Artificial Sequence; identical to SEQ ID NO: 26260
  derived and/or modified sequence opt4 from capsid_protein_VP2__Norovirus__AFX81263

SEQ ID NO: 26290 - RNA, 807 nt, Artificial Sequence; identical to SEQ ID NO: 26260
  derived and/or modified sequence opt4 from capsid_protein_VP2__Norovirus__AFX81269

SEQ ID NO: 26291 - RNA, 807 nt, Artificial Sequence; identical to SEQ ID NO: 26252
  derived and/or modified sequence opt4 from capsid_protein_VP2__Norovirus__AFX81272

SEQ ID NO: 26292 - RNA, 807 nt, Artificial Sequence; identical to SEQ ID NO: 26260
  derived and/or modified sequence opt4 from capsid_protein_VP2__Norovirus__AFX81275

SEQ ID NO: 26293 - RNA, 807 nt, Artificial Sequence; identical to SEQ ID NO: 26260
  derived and/or modified sequence opt4 from capsid_protein_VP2__Norovirus__AFX81278

SEQ ID NO: 26294 - RNA, 807 nt, Artificial Sequence
  derived and/or modified sequence opt4 from capsid_protein_VP2__Norovirus__AFX81281
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcgcccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26295 - RNA, 807 nt, Artificial Sequence; identical to SEQ ID NO: 26260
  derived and/or modified sequence opt4 from capsid_protein_VP2__Norovirus__AFX81284

SEQ ID NO: 26296 - RNA, 807 nt, Artificial Sequence
  derived and/or modified sequence opt4 from capsid_protein_VP2__Norovirus__AFX81287
auggccggcgccuucuucgccggccuggccagcgacgugcugggcagcggccugagcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgcccccaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26297 - RNA, 807 nt, Artificial Sequence; identical to SEQ ID NO: 26260
  derived and/or modified sequence opt4 from capsid_protein_VP2__Norovirus__AFX81290

SEQ ID NO: 26298 - RNA, 807 nt, Artificial Sequence; identical to SEQ ID NO: 26252
  derived and/or modified sequence opt4 from capsid_protein_VP2__Norovirus__AFX81293

SEQ ID NO: 26299 - RNA, 807 nt, Artificial Sequence
  derived and/or modified sequence opt4 from capsid_protein_VP2__Norovirus__AFX81296
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagagugaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26300 - RNA, 807 nt, Artificial Sequence
  derived and/or modified sequence opt4 from capsid_protein_VP2__Norovirus__AFX81299
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacuggacccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26301 - RNA, 807 nt, Artificial Sequence
  derived and/or modified sequence opt4 from capsid_protein_VP2__Norovirus__AFX81302
auggccggcgccuucuucgccggccuggccagcgacgugcugagcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacagcgccggcagauucagcaccccccagcccagcggcgcccugcccggcagaaccaaccccagagcccccauccccgccagaggcagccccagcaccagcagcggcgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26302 - RNA, 807 nt, Artificial Sequence
  derived and/or modified sequence opt4 from capsid_protein_VP2__Norovirus__AFX81305
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcgaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacagcgccggcagauucagcaccccccagcccagcggcacccugcccggcagaaccaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26303 - RNA, 807 nt, Artificial Sequence; identical to SEQ ID NO: 26252
  derived and/or modified sequence opt4 from capsid_protein_VP2__Norovirus__AFX81308

SEQ ID NO: 26304 - RNA, 807 nt, Artificial Sequence; identical to SEQ ID NO: 26260
  derived and/or modified sequence opt4 from capsid_protein_VP2__Norovirus__AFX81311

SEQ ID NO: 26305 - RNA, 807 nt, Artificial Sequence; identical to SEQ ID NO: 26252
  derived and/or modified sequence opt4 from capsid_protein_VP2__Norovirus__AFX81314

SEQ ID NO: 26306 - RNA, 807 nt, Artificial Sequence; identical to SEQ ID NO: 26252
  derived and/or modified sequence opt4 from capsid_protein_VP2__Norovirus__AFX81317

SEQ ID NO: 26307 - RNA, 807 nt, Artificial Sequence; identical to SEQ ID NO: 26252
  derived and/or modified sequence opt4 from capsid_protein_VP2__Norovirus__AFX81320

SEQ ID NO: 26308 - RNA, 807 nt, Artificial Sequence
  derived and/or modified sequence opt4 from capsid_protein_VP2__Norovirus__AFX81323
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacagcgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26309 - RNA, 807 nt, Artificial Sequence; identical to SEQ ID NO: 26260
  derived and/or modified sequence opt4 from capsid_protein_VP2__Norovirus__AFX81326

SEQ ID NO: 26310 - RNA, 807 nt, Artificial Sequence; identical to SEQ ID NO: 26252
  derived and/or modified sequence opt4 from capsid_protein_VP2__Norovirus__AGE89434

SEQ ID NO: 26311 - RNA, 807 nt, Artificial Sequence; identical to SEQ ID NO: 26252
  derived and/or modified sequence opt4 from capsid_protein_VP2__Norovirus__AGE89437

SEQ ID NO: 26312 - RNA, 807 nt, Artificial Sequence
  derived and/or modified sequence opt4 from capsid_protein_VP2__Norovirus__AGE89440
auggccggcgccuucuucgccggccuggccagcgacgugcugggcagcggccugggcagccugaucagcgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26313 - RNA, 807 nt, Artificial Sequence
  derived and/or modified sequence opt4 from capsid_protein_VP2__Norovirus__AGE89443
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccagcagcaacgccagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26314 - RNA, 807 nt, Artificial Sequence
  derived and/or modified sequence opt4 from capsid_protein_VP2__Norovirus__AGE89449
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgugcugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26315 - RNA, 807 nt, Artificial Sequence; identical to SEQ ID NO: 26294
  derived and/or modified sequence opt4 from capsid_protein_VP2__Norovirus__AGE89455

SEQ ID NO: 26316 - RNA, 807 nt, Artificial Sequence; identical to SEQ ID NO: 26252
  derived and/or modified sequence opt4 from capsid_protein_VP2__Norovirus__AGE89458

SEQ ID NO: 26317 - RNA, 807 nt, Artificial Sequence; identical to SEQ ID NO: 26260
  derived and/or modified sequence opt4 from capsid_protein_VP2__Norovirus__AGE89461

SEQ ID NO: 26318 - RNA, 807 nt, Artificial Sequence
  derived and/or modified sequence opt4 from capsid_protein_VP2__Norovirus__AGE89464
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcacccccagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26319 - RNA, 807 nt, Artificial Sequence; identical to SEQ ID NO: 26252
  derived and/or modified sequence opt4 from capsid_protein_VP2__Norovirus__AGE89467

SEQ ID NO: 26320 - RNA, 807 nt, Artificial Sequence
  derived and/or modified sequence opt4 from capsid_protein_VP2__Norovirus__AGE89470
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagagccaccaccuacaacgccggcagauucagcaccccccagcccagcggcacccugcccggcagaaucaaccccagaacccccacccccgccagaggcagccccagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26321 - RNA, 807 nt, Artificial Sequence
  derived and/or modified sequence opt4 from capsid_protein_VP2__Norovirus__AGE89473
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcgcccugcccggcagaaucaaccccagaacccccacccccgccagaggcagcagcagcaccagcagcaacgccagcaucgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26322 - RNA, 807 nt, Artificial Sequence
  derived and/or modified sequence opt4 from capsid_protein_VP2__Norovirus__AGE89476
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcuucaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26323 - RNA, 807 nt, Artificial Sequence
  derived and/or modified sequence opt4 from capsid_protein_VP2__Norovirus__AGE89479
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagagcagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccaccccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26324 - RNA, 807 nt, Artificial Sequence; identical to SEQ ID NO: 26260
  derived and/or modified sequence opt4 from capsid_protein_VP2__Norovirus__AGE89482

SEQ ID NO: 26325 - RNA, 807 nt, Artificial Sequence
  derived and/or modified sequence opt4 from capsid_protein_VP2__Norovirus__AGE89485
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgccagaaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26326 - RNA, 807 nt, Artificial Sequence
  derived and/or modified sequence opt4 from capsid_protein_VP2__Norovirus__AGE89488
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcgccccccagcccagcggcagccugcccggcagaaucaaccccagagcccccacccccgccagagugagcagcagcaccagcagcaacgccagcaccgugaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26327 - RNA, 807 nt, Artificial Sequence; identical to SEQ ID NO: 26252
  derived and/or modified sequence opt4 from capsid_protein_VP2__Norovirus__AGE89491

SEQ ID NO: 26328 - RNA, 807 nt, Artificial Sequence
  derived and/or modified sequence opt4 from capsid_protein_VP2__Norovirus__AGE89494
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaucaccuacaacgccggcagauucagcaccccccagcccagcggcacccugcccggcagaaucaaccccagagcccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26329 - RNA, 807 nt, Artificial Sequence
  derived and/or modified sequence opt4 from capsid_protein_VP2__Norovirus__AGE89497
auggccggcgccuucuucgccggccuggccagcgacgugcugggcagcggccugggcagccugaucagcgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26330 - RNA, 807 nt, Artificial Sequence; identical to SEQ ID NO: 26252
  derived and/or modified sequence opt4 from capsid_protein_VP2__Norovirus__AGE89500

SEQ ID NO: 26331 - RNA, 807 nt, Artificial Sequence; identical to SEQ ID NO: 26252
  derived and/or modified sequence opt4 from capsid_protein_VP2__Norovirus__AGE89503

SEQ ID NO: 26332 - RNA, 807 nt, Artificial Sequence
  derived and/or modified sequence opt4 from capsid_protein_VP2__Norovirus__AGE89506
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcaugcacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26333 - RNA, 807 nt, Artificial Sequence
  derived and/or modified sequence opt4 from capsid_protein_VP2__Norovirus__AGE89509
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcagccugcccggcagaaucaaccccagagcccccacccccgccagagccagcagcagcaucagcagcaacgccagcaccgugaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26334 - RNA, 807 nt, Artificial Sequence; identical to SEQ ID NO: 26252
  derived and/or modified sequence opt4 from capsid_protein_VP2__Norovirus__AGE89512

SEQ ID NO: 26335 - RNA, 807 nt, Artificial Sequence; identical to SEQ ID NO: 26260
  derived and/or modified sequence opt4 from capsid_protein_VP2__Norovirus__AGE89515

SEQ ID NO: 26336 - RNA, 807 nt, Artificial Sequence
  derived and/or modified sequence opt4 from capsid_protein_VP2__Norovirus__AGE89518
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcagaccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26337 - RNA, 807 nt, Artificial Sequence
  derived and/or modified sequence opt4 from capsid_protein_VP2__Norovirus__AGE89521
auggccggcgccuucuucgccggccuggccagcgacgugcugggcagcggccugggcagccugaucaacgccggcgccggcgccaucaaccagaagaucgacuucgagaacaacagaaagcugcagcaggugagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26338 - RNA, 807 nt, Artificial Sequence; identical to SEQ ID NO: 26252
  derived and/or modified sequence opt4 from capsid_protein_VP2__Norovirus__AGE89524

SEQ ID NO: 26339 - RNA, 807 nt, Artificial Sequence
  derived and/or modified sequence opt4 from capsid_protein_VP2__Norovirus__AGE89530
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaccaaccccagaacccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26340 - RNA, 807 nt, Artificial Sequence
  derived and/or modified sequence opt4 from capsid_protein_VP2__Norovirus__AGE89533
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaucaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacagcgccggcagauucagcaccccccagcccagcggcacccugcccggcagaaucaaccccagaacccccacccccgccagaggcagcagcagcaccuucagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26341 - RNA, 807 nt, Artificial Sequence; identical to SEQ ID NO: 26260
  derived and/or modified sequence opt4 from capsid_protein_VP2__Norovirus__AGE89536

SEQ ID NO: 26342 - RNA, 807 nt, Artificial Sequence; identical to SEQ ID NO: 26260
  derived and/or modified sequence opt4 from capsid_protein_VP2__Norovirus__AGE89539

SEQ ID NO: 26343 - RNA, 807 nt, Artificial Sequence; identical to SEQ ID NO: 26260
  derived and/or modified sequence opt4 from capsid_protein_VP2__Norovirus__AGE89542

SEQ ID NO: 26344 - RNA, 807 nt, Artificial Sequence; identical to SEQ ID NO: 26260
  derived and/or modified sequence opt4 from capsid_protein_VP2__Norovirus__AGE89545

SEQ ID NO: 26345 - RNA, 807 nt, Artificial Sequence
  derived and/or modified sequence opt4 from capsid_protein_VP2__Norovirus__AGE89548
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaucaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26346 - RNA, 807 nt, Artificial Sequence; identical to SEQ ID NO: 26252
  derived and/or modified sequence opt4 from capsid_protein_VP2__Norovirus__AGE89551

SEQ ID NO: 26347 - RNA, 807 nt, Artificial Sequence
  derived and/or modified sequence opt4 from capsid_protein_VP2__Norovirus__AGE89554
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcgccccccagcccagcggcagccugcccggcagaaucaaccccagagcccccacccccgccagagugagcagcagcaccagcagcaacgccagcaccgugaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacgugagaagaagaggcgagagcagaguguga

SEQ ID NO: 26348 - RNA, 807 nt, Artificial Sequence; identical to SEQ ID NO: 26260
  derived and/or modified sequence opt4 from capsid_protein_VP2__Norovirus__AGE89557

SEQ ID NO: 26349 - RNA, 807 nt, Artificial Sequence
  derived and/or modified sequence opt4 from capsid_protein_VP2__Norovirus__AGE89560
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaacagcagaacccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26350 - RNA, 807 nt, Artificial Sequence
  derived and/or modified sequence opt4 from capsid_protein_VP2__Norovirus__AGE89563
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcaugcugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26351 - RNA, 807 nt, Artificial Sequence
  derived and/or modified sequence opt4 from capsid_protein_VP2__Norovirus__AGE89566
auggccggcgccuucuucgccggccuggccagcgacgugcugagcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaauccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26352 - RNA, 807 nt, Artificial Sequence; identical to SEQ ID NO: 26260
  derived and/or modified sequence opt4 from capsid_protein_VP2__Norovirus__AGE89569

SEQ ID NO: 26353 - RNA, 807 nt, Artificial Sequence; identical to SEQ ID NO: 26260
  derived and/or modified sequence opt4 from capsid_protein_VP2__Norovirus__AGE89572

SEQ ID NO: 26354 - RNA, 807 nt, Artificial Sequence
  derived and/or modified sequence opt4 from capsid_protein_VP2__Norovirus__AGE89578
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcuggagagagugaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26355 - RNA, 807 nt, Artificial Sequence
  derived and/or modified sequence opt4 from capsid_protein_VP2__Norovirus__AGE89581
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggaggugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26356 - RNA, 807 nt, Artificial Sequence; identical to SEQ ID NO: 26350
  derived and/or modified sequence opt4 from capsid_protein_VP2__Norovirus__AGE89587

SEQ ID NO: 26357 - RNA, 807 nt, Artificial Sequence
  derived and/or modified sequence opt4 from capsid_protein_VP2__Norovirus__AGE89590
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccgagagagugaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26358 - RNA, 807 nt, Artificial Sequence; identical to SEQ ID NO: 26252
  derived and/or modified sequence opt4 from capsid_protein_VP2__Norovirus__AGE89593

SEQ ID NO: 26359 - RNA, 807 nt, Artificial Sequence
  derived and/or modified sequence opt4 from capsid_protein_VP2__Norovirus__AGE89596
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26360 - RNA, 807 nt, Artificial Sequence
  derived and/or modified sequence opt4 from capsid_protein_VP2__Norovirus__AGE89599
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaccaaccccagaacccccacccccgccagaggcagcagcagcaucagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26361 - RNA, 807 nt, Artificial Sequence
  derived and/or modified sequence opt4 from capsid_protein_VP2__Norovirus__AGE89602
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgccagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26362 - RNA, 807 nt, Artificial Sequence
  derived and/or modified sequence opt4 from capsid_protein_VP2__Norovirus__AGE89605
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaagccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26363 - RNA, 807 nt, Artificial Sequence
  derived and/or modified sequence opt4 from capsid_protein_VP2__Norovirus__AGE89608
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccacagcaaccagaccgugagcaccagacugggcuacaccgccggcagcggcaccaacgugagcagccugcccagcaccgccagaaccagaagcuggguggaggaccagaacagaagccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26364 - RNA, 807 nt, Artificial Sequence
  derived and/or modified sequence opt4 from capsid_protein_VP2__Norovirus__AGE89611
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucagcgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgcccccaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26365 - RNA, 807 nt, Artificial Sequence
  derived and/or modified sequence opt4 from capsid_protein_VP2__Norovirus__AGE89614
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcgagacccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaagccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26366 - RNA, 807 nt, Artificial Sequence; identical to SEQ ID NO: 26359
  derived and/or modified sequence opt4 from capsid_protein_VP2__Norovirus__AGE89617

SEQ ID NO: 26367 - RNA, 807 nt, Artificial Sequence; identical to SEQ ID NO: 26267
  derived and/or modified sequence opt4 from capsid_protein_VP2__Norovirus__AGE89620

SEQ ID NO: 26368 - RNA, 807 nt, Artificial Sequence
  derived and/or modified sequence opt4 from capsid_protein_VP2__Norovirus__AGE89623
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuacgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26369 - RNA, 807 nt, Artificial Sequence
  derived and/or modified sequence opt4 from capsid_protein_VP2__Norovirus__AGE89626
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26370 - RNA, 807 nt, Artificial Sequence
  derived and/or modified sequence opt4 from capsid_protein_VP2__Norovirus__AGE89629
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcggcgccaaccugagagccaccgugcccgccagaggcagcagcagcaccuucagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26371 - RNA, 807 nt, Artificial Sequence; identical to SEQ ID NO: 26252
  derived and/or modified sequence opt4 from capsid_protein_VP2__Norovirus__AGE89635

SEQ ID NO: 26372 - RNA, 807 nt, Artificial Sequence
  derived and/or modified sequence opt4 from capsid_protein_VP2__Norovirus__AGE89638
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgccagcaccgccaccagcauccaccugaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26373 - RNA, 807 nt, Artificial Sequence
  derived and/or modified sequence opt4 from capsid_protein_VP2__Norovirus__AGE89641
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaccagcagcaacgugagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26374 - RNA, 807 nt, Artificial Sequence
  derived and/or modified sequence opt4 from capsid_protein_VP2__Norovirus__AGE89644
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcgcccugcccggcagaaucaaccccagaacccccacccccgccagaggcagcagcagcaccagcagcaacgccagcaccgccaccagcauccacagcaaccagaccgugagcaccagacugggcagcaccgccggcagcggcaccaacgugagcggccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26375 - RNA, 807 nt, Artificial Sequence
  derived and/or modified sequence opt4 from capsid_protein_VP2__Norovirus__AGE89647
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcaucagcagcaacgccagcaccgccaccagcauccacagcaaccagaccgugagcaccagacugggcagcaccgccggcagcggcaccaacgugagcagcuuccccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26376 - RNA, 807 nt, Artificial Sequence; identical to SEQ ID NO: 26350
  derived and/or modified sequence opt4 from capsid_protein_VP2__Norovirus__AGE89650

SEQ ID NO: 26377 - RNA, 807 nt, Artificial Sequence
  derived and/or modified sequence opt4 from capsid_protein_VP2__Norovirus__AGE89653
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggccacuucagcaccccccagagcagcggcgcccugcccggcagagccaaccugagagccgccgugcccgccagaggcagcagcagcaccagcagcaacagcagcaccgccaccagcguguacagcaaccagaccaucagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagacccagcagccagggcaccgugagcaccgugcccaaggaggugcuggacagcuggaccggcgccuucaacaccagaagacagccccuguucgcccacaucagaaagagaggcgagagcagagccuga

SEQ ID NO: 26378 - RNA, 807 nt, Artificial Sequence; identical to SEQ ID NO: 26260
  derived and/or modified sequence opt4 from capsid_protein_VP2__Norovirus__AGE89656

SEQ ID NO: 26379 - RNA, 807 nt, Artificial Sequence
  derived and/or modified sequence opt4 from capsid_protein_VP2__Norovirus__AGE89659
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaauccccacccccgccagaggcagcagcagcaccagcagcaacgccagcaccgccaccagcaucuacagcaaccagaccgugagcaccagacugggcagcgccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26380 - RNA, 807 nt, Artificial Sequence
  derived and/or modified sequence opt4 from capsid_protein_VP2__Norovirus__AGE89662
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcaacaccagcagcaacgccagcaccgccaccagcauccacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26381 - RNA, 807 nt, Artificial Sequence; identical to SEQ ID NO: 26267
  derived and/or modified sequence opt4 from capsid_protein_VP2__Norovirus__AGE89665

SEQ ID NO: 26382 - RNA, 807 nt, Artificial Sequence; identical to SEQ ID NO: 26380
  derived and/or modified sequence opt4 from capsid_protein_VP2__Norovirus__AGE89668

SEQ ID NO: 26383 - RNA, 807 nt, Artificial Sequence
  derived and/or modified sequence opt4 from capsid_protein_VP2__Norovirus__AGE89671
auggccggcgccuucuucgccggccuggccagcgacgugcugggcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucagcgcccccaugaccaaggugcuggacuggagcggcaccagauacugggcccccgacgccagaaccaccaccuacaacagcggcagauucagcaccccccagcccagcggcacccugcccggcagaaucaaccccagaacccccacccccgccagaggcagcagcagcaccagcagcaacgccagcaccgccaccagcauccaccugaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggagauccuggacagcugggccggcgccuucaacaccagaagacagccccuguucgcccacaucagaagaagaggcgagagcagaguguga

SEQ ID NO: 26384 - RNA, 807 nt, Artificial Sequence; identical to SEQ ID NO: 26380
  derived and/or modified sequence opt4 from capsid_protein_VP2__Norovirus__AGE89674

SEQ ID NO: 26385 - RNA, 807 nt, Artificial Sequence
  derived and/or modified sequence opt4 from capsid_protein_VP2__Norovirus__AGE99604
auggccggcgccuucuucgccggccuggccagcgacgugcugagcagcggccugggcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagcugaugaaggugaagcagaccauccugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagaaucaaccccagaacccccauccccgccagaggcagccccagcaucagcagcaacgccagcaccgccaccagcauccacagcaaccagaccgccagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggacgugcuggacagcuggaccggcgccuucaacaccagaagacagccccuguucgcccacaucagaagaagaggcgagagcagaguguga

SEQ ID NO: 26386 - RNA, 807 nt, Artificial Sequence
  derived and/or modified sequence opt4 from capsid_protein_VP2__Norovirus__AGE99607
auggccggccccuucuucgccggccuggccagcgacgugcugggcagcggccugggcagccugaucagcgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccacccagaagcugcagcaggagcugaugaaggugaagcaggccgugcugcuggagggcggcuucagcaccaccgacgccgccagaggcgccaucaacgcccccaugaccaaggcccuggacuggagcggcaccagauacugggcccccgacgccagaaucaccaccuacaacgccggcagauucagcaccccccagccccugggcgcccugcccggcagaaccaaccccagagugcccgccagcgccagaagcagccccagcagccugagcaacgcccccaccgccaccagcguguacagcaaccagaccgccagcaccagacugggcagcagcgccggcagcggcgccggcgugagcagccugcccagcaccgccagaaccagaagcuggguggaggaccagaacaagaaccugagccccuucaugaagggcgcccugaacaccagcuucgugaccccccccagcagcagaagcagcaaccagggcaccgugagcaccgugcccaaggagauccuggacagcuggaccggcgccuucaacaccagaagacagccccuguucgcccacaucagaaagagaggcgagagcagaguguga

SEQ ID NO: 26387 - RNA, 807 nt, Artificial Sequence
  derived and/or modified sequence opt4 from capsid_protein_VP2__Norovirus__AGK36312
auggccggcgccuucuucgccggccuggccagcgacgugcugggcagcggccugggcagccugaucaacgccggcgccggcgccaucaaccagaagaucgacuucgagaacaacagagagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcacccugcccggcagaaucaaccccagaacccccacccccgccagaggcagcagcagcgccagcagcaacgccagcaccgccaccagcaucuacagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26388 - RNA, 807 nt, Artificial Sequence; identical to SEQ ID NO: 26359
  derived and/or modified sequence opt4 from capsid_protein_VP2__Norovirus__AGK36315

SEQ ID NO: 26389 - RNA, 639 nt, Artificial Sequence
  derived and/or modified sequence opt4 from capsid_protein_VP2__Norovirus__AGM33209
auggcccaggccaucaucggcgccaucgccgccagcaccgccggcagcgcccugggcgccggcauccaggugggcggcgaggccgcccugcagagccagagauaccagcagaaccugcagcugcaggagaacagcuucaagcacgacagagagaugaucggcuaccagguggaggccagcaaccagcugcuggccaagaaccuggccaccagauacagccugcugagagccggcggccugaccagcgccgacgccgccagaagcguggccggcgcccccgugaccagaaucguggacuggaacggcgugagagugagcgcccccgagagcagcgccaccacccugagaagcggcggcuucaugagcgugcccauccccuucgccagcaagcagaagcaggugcagagcagcggcaucagcaaccccaacuacagccccagcagcaucagcagaaccaccagcuggguggagagccagaacagcagcagauucggcaaccugagccccuaccacgccgaggcccugaacaccguguggcugaccccccccggcagcaccgccagcagcacccugagcagcgugcccagaggcuacuucaacaccgacagacugccccuguucgccaacaacagaagauga

SEQ ID NO: 26390 - RNA, 639 nt, Artificial Sequence
  derived and/or modified sequence opt4 from capsid_protein_VP2__Norovirus__AGM33215
auggcccaggccaucaucggcgccaucgccgccagcaccgccggcagcgcccugggcgccggcauccaggugggcggcgaggccgcccugcagagccagagauaccagcagaaccugcagcugcaggagaacagcuucaagcacgacagagagaugaucggcuaccagguggaggccagcaaccagcugcuggccaagaaccuggccaccagauacagccugcugagagccggcggccugaccagcgccgacgccgccagaagcguggccggcgugcccgugaccagaaucguggacuggaacggcgugagagugagcgcccccgagagcagcgccaccacccugagaagcggcggcuucaugagcgugcccauccccuucgccagcaagcagaagcaggugcagagcagcggcaucagcaaccccaacuacagccccagcagcaucagcagaaccaccagcuggguggagagccagaacagcagcagauucggcaaccugagccccuaccacgccgaggcccugaacaccguguggcugaccccccccggcagcaccgccagcagcacccugagcagcgugcccagaggcuacuucaacaccgacagacugccccuguucgccaacaacagaagauga

SEQ ID NO: 26391 - RNA, 639 nt, Artificial Sequence; identical to SEQ ID NO: 26389
  derived and/or modified sequence opt4 from capsid_protein_VP2__Norovirus__AGM33218

SEQ ID NO: 26392 - RNA, 639 nt, Artificial Sequence; identical to SEQ ID NO: 26389
  derived and/or modified sequence opt4 from capsid_protein_VP2__Norovirus__AGM33221

SEQ ID NO: 26393 - RNA, 639 nt, Artificial Sequence; identical to SEQ ID NO: 26390
  derived and/or modified sequence opt4 from capsid_protein_VP2__Norovirus__AGM33224

SEQ ID NO: 26394 - RNA, 639 nt, Artificial Sequence; identical to SEQ ID NO: 26389
  derived and/or modified sequence opt4 from capsid_protein_VP2__Norovirus__AGM33227

SEQ ID NO: 26395 - RNA, 639 nt, Artificial Sequence; identical to SEQ ID NO: 26390
  derived and/or modified sequence opt4 from capsid_protein_VP2__Norovirus__AGM33230

SEQ ID NO: 26396 - RNA, 639 nt, Artificial Sequence
  derived and/or modified sequence opt4 from capsid_protein_VP2__Norovirus__AGM33233
auggcccaggccaucaucggcgccaucgccgccagcaccgccggcagcgcccugggcgccggcauccaggugggcggcgaggccgcccugcagagccagagauaccagcagaaccugcagcugcaggagaacagcuucaagcacgacagagagaugaucggcuaccagguggaggccagcaaccagcugcuggccaagaaccuggccaccagauacagccugcugagagccggcggccugaccagcgccgacgccgccagaagcguggccggcgugcccgugaccagaaucguggacuggaacggcgugagagugagcgcccccgagagcagcgccaccacccugagaagcggcggcuucaugagcgugcccauccccuucgccagcaagcagaagcagauccagagcagcggcaucagcaaccccaacuacagccccagcagcaucagcagaaccaccagcuggguggagagccagaacagcagcagauucggcaaccugagccccuaccacgccgaggcccugaacaccguguggcugaccccccccggcagcaccgccagcagcacccugagcagcgugcccagaggcuacuucaacaccgacagacugccccuguucgccaacaacagaagauga

SEQ ID NO: 26397 - RNA, 639 nt, Artificial Sequence; identical to SEQ ID NO: 26389
  derived and/or modified sequence opt4 from capsid_protein_VP2__Norovirus__AGM33236

SEQ ID NO: 26398 - RNA, 639 nt, Artificial Sequence; identical to SEQ ID NO: 26389
  derived and/or modified sequence opt4 from capsid_protein_VP2__Norovirus__AGM33239

SEQ ID NO: 26399 - RNA, 639 nt, Artificial Sequence; identical to SEQ ID NO: 26389
  derived and/or modified sequence opt4 from capsid_protein_VP2__Norovirus__AGM33242

SEQ ID NO: 26400 - RNA, 639 nt, Artificial Sequence; identical to SEQ ID NO: 26390
  derived and/or modified sequence opt4 from capsid_protein_VP2__Norovirus__AGM33245

SEQ ID NO: 26401 - RNA, 639 nt, Artificial Sequence; identical to SEQ ID NO: 26389
  derived and/or modified sequence opt4 from capsid_protein_VP2__Norovirus__AGT17786

SEQ ID NO: 26402 - RNA, 639 nt, Artificial Sequence; identical to SEQ ID NO: 26389
  derived and/or modified sequence opt4 from capsid_protein_VP2__Norovirus__AGT17793

SEQ ID NO: 26403 - RNA, 807 nt, Artificial Sequence
  derived and/or modified sequence opt4 from capsid_protein_VP2__Norovirus__AGT17796
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaucgagaugcugcaggcccagaucgaggccaccaagaagcugcagcaggagaugaugagagccaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccagcccggcagagccaaccugagagccaccgugcccgccagaggcagcagcagcaccagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26404 - RNA, 807 nt, Artificial Sequence
  derived and/or modified sequence opt4 from capsid_protein_VP2__Norovirus__AGT17799
auggccggcgccuucuucgccggccuggccagcgacgugcugggcagcggccugggcagccugaucaacgccggcgccggcgccaucaaccagaagguggaguucgagaacaacagaaagcugcagcaggacagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccggcgccagaaccaccaccuacaacgccggcuacuucagcaccccccagcacagcggcgcccugcccggcagagccaaccugagagccguggugcccgccagaggcagcagcagagugagcagcaacagcagcaccgccaccagcguguacagcaaccagaccgccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagccaggccggcguguucaacaccagaagacagccccuguucgcccacaucagaagaagaggcgagagcagagccuga

SEQ ID NO: 26405 - RNA, 639 nt, Artificial Sequence; identical to SEQ ID NO: 26389
  derived and/or modified sequence opt4 from capsid_protein_VP2__Norovirus__AGT17804

SEQ ID NO: 26406 - RNA, 639 nt, Artificial Sequence; identical to SEQ ID NO: 26389
  derived and/or modified sequence opt4 from capsid_protein_VP2__Norovirus__AGT17807

SEQ ID NO: 26407 - RNA, 639 nt, Artificial Sequence; identical to SEQ ID NO: 26389
  derived and/or modified sequence opt4 from capsid_protein_VP2__Norovirus__AGT17810

SEQ ID NO: 26408 - RNA, 807 nt, Artificial Sequence
  derived and/or modified sequence opt4 from capsid_protein_VP2__Norovirus__AGT17814
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcagagccagaucgacgccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagcccagcggcgccccccccggcagagccaaccugagagccgccgugcccgccagaggcagcagcagcaccagcagcaacagcagcaucgccaccagcauguacagcaaccagaccaccagcaccagacugggcagcaccgccggcagcggcaccagcgugagcagccugcccagcagcgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26409 - RNA, 807 nt, Artificial Sequence
  derived and/or modified sequence opt4 from capsid_protein_VP2__Norovirus__AGT17820
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagccaagcaggccaugcugcuggagggcggcuucagcgagaccgacgccgccagaggcgccaucaacgcccccaugaccaagacccuggacuggagcggcaccagauacugggcccccgacgccagaaccaccaccuacagcgccggcagauucagcaccccccagcccagcggcgcccugcccggcagagccaaccugagagccaccgugcccgccagaggcagcagcagcaccagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26410 - RNA, 807 nt, Artificial Sequence
  derived and/or modified sequence opt4 from capsid_protein_VP2__Norovirus__AGT17824
auggccggcgccuucuucgccggccuggccagcgacgugcugggcagcggccugggcagccugaucaacgccggcgccggcgccaucaaccagaagguggaguucgagaacaacagaaagcugcagcaggacagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggccacuucagcaccccccagcacagcggcgcccugcccggcagagccaaccugagagccaccgugcccgccagaggcagcagcagagccagcagcaacagcagcaccgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagcagaaccggcgccuucaacaccagaagacagccccuguucgcccacaucagaagacagggcgagagcagagccuga

SEQ ID NO: 26411 - RNA, 639 nt, Artificial Sequence; identical to SEQ ID NO: 26389
  derived and/or modified sequence opt4 from capsid_protein_VP2__Norovirus__AGT17827

SEQ ID NO: 26412 - RNA, 807 nt, Artificial Sequence
  derived and/or modified sequence opt4 from capsid_protein_VP2__Norovirus__AGT17831
auggccggcgccaucaucgccggccuggccagcgacgugcugagcagcggccugggcagccugaucaacgccggcgccggcgugaucaaccagaagguggacuucgagaacaacaagcagcugcagcagaacagcuuccaguucagcagcaaccugcagcaggccagcuuccagcacgacaaggagaugcugcaggcccagaucgaggccaccaagaagcugcagcaggagaugaugggcaucaagcaggccgugcugcugaagggcggcuucagcgagaccgacgccgccagaggcgccgugaacgcccccaugaccaaggugcuggacuggagcggcaccagauacugggcccccaacgccagcaccaccaccuacaacgccggcagauucagcaccccccagcccagcggcgcccugcccggcagaaccaaccugagaaccgccgcccccgccagaggcagccccagcaucagcagcaacgccagcaccgccaccagcguguacagcaaccagaccgugagcaccagacugggcaccagcgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26413 - RNA, 639 nt, Artificial Sequence; identical to SEQ ID NO: 26389
  derived and/or modified sequence opt4 from capsid_protein_VP2__Norovirus__AGT17837

SEQ ID NO: 26414 - RNA, 807 nt, Artificial Sequence
  derived and/or modified sequence opt4 from capsid_protein_VP2__Norovirus__AGT17843
auggccggcgccuucuucgccggccuggccagcgacgugcugggcagcggccugggcagccugaucaacgccggcgccggcgccaucaaccagaagguggaguucgagaacaacagaaagcugcagcaggacagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggaacggcaccagauacugggcccccggcgccagaaccaccaccuacaacgccggccacuucagcaccccccagcacagcggcgcccugcccggcagagccaaccugagagccgccgugcccgccagaggcagcagcagagccagcagcaacagcagcaccgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagccagaccggcgccuucaacaccagaagacagccccuguucgcccacaucagaagaagaggcgagagcagagccuga

SEQ ID NO: 26415 - RNA, 807 nt, Artificial Sequence
  derived and/or modified sequence opt4 from capsid_protein_VP2__Norovirus__AGX85887
auggccggcgccuucuucgccggccuggccagcgacgugcugagcagcggccugggcagccugaucaacgccggcgccggcgccaucaaccagaccguggaguucgagaacaacagaaagcugcagcaggccagcuuccaguucagcagcaaccugcagcaggccagcuuccagcacgacaaggagaugcugcagagccagaucgacgccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccgacgccagaaccaccaccuacaacgccggcagauucagcaccccccagagcagcggcgccccccccggcagagccaaccugagagccgccgugcccgcccagggcagcagcagcaccagcagcaacagcagcaucgccaccagcauguacagcaaccagaccaccagcaccagacugggcagcaccgccggcagcggcaccagcgugagcagccugcccagcagcgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26416 - RNA, 807 nt, Artificial Sequence
  derived and/or modified sequence opt4 from capsid_protein_VP2__Norovirus__AGX85893
auggccggcgccuucuucgccggccuggccagcgacgugcugggcagcggccugggcagccugaucaacgccggcgccggcgccaucaaccagaagguggaguucgagaacaacagaaagcugcagcaggacagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccggcgccagaaccaccaccuacaacgccggcuacuucagcaccccccagcacagcggcgcccugcccggcagagccaaccugagagccgccgugcccgccagaggcagcagcagagugagcagcaacagcagcaccgccaccagcguguacagcaaccagaccgccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagccagaccggcguguucaacaccagaagacagccccuguucgcccacaucagaagaagaggcgagagcagagccuga

SEQ ID NO: 26417 - RNA, 807 nt, Artificial Sequence
  derived and/or modified sequence opt4 from capsid_protein_VP2__Norovirus__AGX85896
auggccggcgccuucuucgccggccuggccagcgacgugcugggcagcggccugggcagccugaucaacgccggcgccggcgccaucaaccagaagguggaguucgagaacaacagaaagcugcagcaggacagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccggcgccagaaccaccaccuacaacgccggcuacuucagcaccccccagcacagcggcgcccugcccggcagagccaaccugagagccgccgugcccgccagaggcagcagcagagugagcagcaacagcagcaccgccaccagcguguacagcaaccagaccgccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagccagaccggcgccuucaacaccagaagacagccccuguucgcccacaucagaagaagaggcgagagcagagccuga

SEQ ID NO: 26418 - RNA, 807 nt, Artificial Sequence
  derived and/or modified sequence opt4 from capsid_protein_VP2__Norovirus__AGX85905
auggccggcgccuucuucgccggccuggccagcgacgugcugagcagcggccugggcagccugaucaacgccggcgccggcgccaucaaccagagaaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagcugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagaaucaaccccagaacccccauccccgccagaggcagccccagcaucagcagcaacgugagcaccgccaacagcauccacagcaaccagaccgccagcaccagacugggcagcaccgccggcagcggcaccgacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggacgugcuggacagcuggaccggcgccuucaacaccagaagacagccccuguucgcccacaucagaagaagaggcgagagcagaguguga

SEQ ID NO: 26419 - RNA, 807 nt, Artificial Sequence
  derived and/or modified sequence opt4 from capsid_protein_VP2__Norovirus__AGX85914
auggccggcgccuucuucgccggccuggccagcgacgugcugggcagcggccugggcagccugaucaacgccggcgccggcgccaucaaccagaagguggaguucgagaacaacagaaagcugcagcaggacagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggugcuggacuggagcggcaccagauacugggcccccggcgccagaaccaccaccuacaacgccggcuacuucagcaccccccagcacagcggcgcccugcccggcagagccaaccugagagccguggugcccgccagaggcagcagcagagugagcagcaacagcagcaccgccaccagcguguacagcaaccagaccgccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcugaacagccagaccggcguguucaacaccagaagacagccccuguucgcccacaucagaagaagaggcgagagcagagccuga

SEQ ID NO: 26420 - RNA, 807 nt, Artificial Sequence; identical to SEQ ID NO: 26415
  derived and/or modified sequence opt4 from capsid_protein_VP2__Norovirus__AGX85917

SEQ ID NO: 26421 - RNA, 807 nt, Artificial Sequence; identical to SEQ ID NO: 26412
  derived and/or modified sequence opt4 from capsid_protein_VP2__Norovirus__AGX85923

SEQ ID NO: 26422 - RNA, 807 nt, Artificial Sequence
  derived and/or modified sequence opt4 from capsid_protein_VP2__Norovirus__AGX85926
auggccggcgccaucaucgccggccuggccagcgacgugcugagcagcggccugggcagccugaucaacgccggcgccggcgccaucaaccagaccaucgacuucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgccccccccggcagagccaaccugagagccaccacccccgccagaggcagcagcagcaccagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaccagaggcgagagcagaguguga

SEQ ID NO: 26423 - RNA, 807 nt, Artificial Sequence; identical to SEQ ID NO: 26419
  derived and/or modified sequence opt4 from capsid_protein_VP2__Norovirus__AGX85932

SEQ ID NO: 26424 - RNA, 807 nt, Artificial Sequence; identical to SEQ ID NO: 26419
  derived and/or modified sequence opt4 from capsid_protein_VP2__Norovirus__AGX85935

SEQ ID NO: 26425 - RNA, 780 nt, Artificial Sequence
  derived and/or modified sequence opt4 from capsid_protein_VP2__Norovirus__AHI59155
auggccagcgccuuccuggccggccuggccggcgacgugaucaccaacggcgugggcagccugaucaacgccggcgccaacgccgugaaccagaagguggaguacgacuucaacaagcagcugcagauggccagcuucaagcacgacaaggagaugcugcagagccaggugcuggccaccaagcagcugcagcaggagaugaugaacaucagacagggcgugcugaccgccggcggcuucagccccgccgacgccgccagaggcgccgugaacgcccccaugaccaagauccuggacuggaacggcaccagauacugggcccccaacagcaugaagaccaccagcuacagcggccaguucagcagcagccccgugcacaagagccccgcccccagccagcacaccgcccugcccaagagcagacugcagaacgacuucgccagcguguacagcuuccccagcagcgugagcagccagagcacccacagcaccgcccugagcgccggcaccggcagcagcagaagcaucagccccagcaccgccacccccacccugagcagaaccagcgacugggugagaggccagaacgagagacugagccccuucauggacggcgcccugcagaccgccuucgugaccccccccagcagcaaggccagcagcaacggcaccgugagcaccgugcccaaggccgugcuggacagcuggacccccauguucaacacccacagacagccccuguucgcccaccccagaagaagaggcgagagccagguguga

SEQ ID NO: 26426 - RNA, 807 nt, Artificial Sequence
  derived and/or modified sequence opt4 from capsid_protein_VP2__Norovirus__AHI59158
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcaacaccagcagcagcagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26427 - RNA, 780 nt, Artificial Sequence
  derived and/or modified sequence opt4 from capsid_protein_VP2__Norovirus__AHI59160
auggccggcgccuucguggccggccuggccggcgacgugcugagcaacggccugagcagccugaucaacgccggcgccaacgccaucaaccagagagccgaguucgacuucaaccagaagcugcagcagaacagcuucaaccacgacaaggagaugcugcaggcccagauccaggccaccaagcagcugcaggccgacaugauggccaucaagcagggcgugcugaccgccggcggcuucagccccgccgacgccgccagaggcgccgugaacgcccccaugacccaggcccuggacuggaacggcaccagauacugggcccccggcagcaugagaaccaccagcuacagcggcaaguucaccagcaccgcccccgugagacaggccgacuuccagcacacccagagcagacccagcagcggcagcagcgugagcagcuucgccacccagagcagcagacccacccugaccaccaccaccggcagcagccacggcaccgccagcagcaacagcaccagaagcaccagccugagccagagcaccgugagcagagccaccagcagaaccagcgagugggugagagaccagaacagaaaccuggagcccuacaugcacggcgcccugcagaccgccuucgugaccccccccagcagcagagccagcgacggcaccgugagcaccgugcccaagggcgugcuggacagcuggacccccgccuucaacaccagaagacagccccuguucgcccaccugagaaagagaggcgagagccacgccuga

SEQ ID NO: 26428 - RNA, 807 nt, Artificial Sequence
  derived and/or modified sequence opt4 from capsid_protein_VP2__Norovirus__AHI59163
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaucaccaccuacaacgccggcagauuccccaccccccagcugagcggcgcccugcccggcagagccaaccugagagccaccgugcccgccagaggcagccccagcaccagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuuccugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26429 - RNA, 807 nt, Artificial Sequence
  derived and/or modified sequence opt4 from capsid_protein_VP2__Norovirus__AHI59166
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcagggcaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagaaacaaccugagagccaccgugcccgccagaggcagcagcagcacccugagcagcauccccaccgccaccagcguguacagcaaccagaccgugagcaccagacugggcagcagcgccggcagcggcaccagcgugagcagccugcccagcaccgccagaaccagaagcuggguggaggaccagaacaagaaccugagccccuucaugagaggcgcccugaacaccagcuucgugaccccccccagcagcagaagcagcagccagggcaccgugagcaccgugcccaaggagauccuggacagcuggaccggcgccuucaacaccagaagacagccccuguucgcccacgugagaaagagaggcgagagcagaguguga

SEQ ID NO: 26430 - RNA, 807 nt, Artificial Sequence
  derived and/or modified sequence opt4 from capsid_protein_VP2__Norovirus__AHX22026
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggugaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagagccaaccugagagugaccgcccccgccagaggcagcagcagcaccagcagcaacagcagcaucgccaccagcguguacagcagccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26431 - RNA, 807 nt, Artificial Sequence
  derived and/or modified sequence opt4 from capsid_protein_VP2__Norovirus__AHX22029
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggugaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgugcugcccggcagagccaaccugagagacgccgugcccgccagaggcagcagcagcaagagcagcaacagcuucaccgccaccagcguguacagcaaccagaccaccagcaccagacugggcagcaccgccggcagcggcaccagcgugagcagccugcccagcaccgccagaaccagaagcuggguggaggaccagagcagaaacgugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26432 - RNA, 807 nt, Artificial Sequence
  derived and/or modified sequence opt4 from capsid_protein_VP2__Norovirus__AHX22033
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggugaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugagcggcagagccaaccugagagccaccgcccccgccagaggcagcagcagcaccagcagcaacagcagcaucgccaccagcguguacagcaaccagaccaccagcaccagacugggcagcaccgccggcagcggcaccagcgugagcagcccccccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26433 - RNA, 807 nt, Artificial Sequence
  derived and/or modified sequence opt4 from capsid_protein_VP2__Norovirus__AHX22036
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccagccugagagccaccgugcccgccagaggcagcagcagcaugagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcaucagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26434 - RNA, 807 nt, Artificial Sequence
  derived and/or modified sequence opt4 from capsid_protein_VP2__Norovirus__AHX22039
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagagccaaccugagagacgccgugcccgccagaggcagcagcagcaagagcagcaacagcagcaccgccaccagcguguacagcaaccagaccaccagcaccagacugggcagcaccgccggcagcggcaccagcgugagcagccugcccagcaccgccagaaccagaagcuggguggaggaccagagcagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26435 - RNA, 807 nt, Artificial Sequence
  derived and/or modified sequence opt4 from capsid_protein_VP2__Norovirus__AHX22042
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgugcugcccggcagagccaaccugagagacgccgugcccgccagaggcagcagcagcaagagcagcaacagcuucaccgccaccagcguguacagcaaccagaccaccagcaccagacugggcagcaccgccggcagcggcaccagcgugagcagccugcccagcaccgccagaaccagaagcuggguggaggaccagagcagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26436 - RNA, 807 nt, Artificial Sequence
  derived and/or modified sequence opt4 from capsid_protein_VP2__Norovirus__AHX22048
auggccggcgccuucuucgccggccuggccagcgacgugcugggcagcggccugagcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagagccaaccugagagccgccgugcccgccagaggcagcagcagcaugagcagcaacagcagcaccgccaccagcguguacagcaaccagaccaccagcaccagacugggcagcaccgccggcagcggcaccagcgugagcagccugcccagcaccgccagaaucagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagagccuga

SEQ ID NO: 26437 - RNA, 807 nt, Artificial Sequence; identical to SEQ ID NO: 26433
  derived and/or modified sequence opt4 from capsid_protein_VP2__Norovirus__AHX22051

SEQ ID NO: 26438 - RNA, 807 nt, Artificial Sequence
  derived and/or modified sequence opt4 from capsid_protein_VP2__Norovirus__AHX22055
auggccggcgccuucuucgccggccuggccagcgacgugcugggcagcggccugagcagccugaucaacgccggcgccggcgccaucaaccagaagguggaguacgagaacaacagaaagcugcagcaggccagcuuccaguucagcagcaaccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgugcccgccagaggcagcagcagcaccagcagcaacagcagcaucgccaccagcguguacagcaaccagaccacccugaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26439 - RNA, 693 nt, Artificial Sequence
  derived and/or modified sequence opt4 from capsid_protein_VP2__Norovirus__AII02849
auggccggcgccuucaucgccggccuggccggcgacaugcugaccaacaccgugggcagccuggugaacgccggcgccaacgccaucaaccagaccaucgacuucgagaacaacaaguaccugcagaacgccagcuucaaccacgacaaggagaugcugaacgcccagaucgaggccaccaagagacugcaggccgacaugaucgccaucaagcagggcgugcugaccgccggcggcuucagccccaccgacgccgccagaggcgccaucaacgcccccaugaccaaggugcuggacuggaacggcaccagauacugggcccccggcgccaccagcaccaccagcaugagcggcggcuucaucaaccagaccgugcacagaagcacccccaacuucaagaccaaccaggcccccaagcccgcccccagcagcggcagcagcgugagaagcaacagcacccagaucaccagccugagcagccacagcagcggcagcagcagaagcagcggcagcaccguggugagcagcauccccagcagcaacagaaccagagacugggugaaccagcagaacuucaaccuggagccccacaugcccggcagccugagaaccgccuucgugaccccccccagcagcaccgccagcagcagcggcaccgugagcaccgugcccaagaacgugcuggacagcuga

SEQ ID NO: 26440 - RNA, 804 nt, Artificial Sequence
  derived and/or modified sequence opt4 from capsid_protein_VP2__Norovirus__AKE07101
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccgugcugcuggagggcggcuucagcgagaccgacgccgccagaggcgccaucaacgcccccaugaccaaggcccuggacuggagcggcaccagauacugggcccccgacgccagaaccaccaccuacaacgccggccacuucagcaccccccagcccagcggcgccccccugggcagagccaaccugagagccgccgugcccaccagaggcagcagcagcaccagcagcaacagcagcaucgccaccagcguguacagcaaccagaccgccagcaccagacugggcagcaccgccggcagcggcgccagcgugagcagccugcccagcaccgccagaaccagaagcuggguggaggaccagagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26441 - RNA, 807 nt, Artificial Sequence
  derived and/or modified sequence opt4 from capsid_protein_VP2__Norovirus__AKE07104
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccgugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcauccugcccggcagagccaaccugagagacaccgugcccgccagaggcagcagcagcaccagcagcaagagcagcaucgccaccagccuguacagcaaccagaccgccaccaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagaguguga

SEQ ID NO: 26442 - RNA, 807 nt, Artificial Sequence
  derived and/or modified sequence opt4 from capsid_protein_VP2__Norovirus__AKE07107
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggacaugcugcaggcccagaucgaggccaccaagaagcugcagcaggagaugaugagagugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggccacuucagcaccccccagcccagcggcgcccugcccggcagagccaaccugagagccgccgugcccgccagaggccccagcagcaccagcagcaacagcagcaccgccaccagcguguacagcaaccagaccaccagcaccagacugggcagcaccgccggcagcggcgccagcgugagcagccugcccagcaccgccagaaccgugaacugggugagagaccagaacagaagccugagccccuucaugagaggcgcccacaacaccagcuucgugaccccccccagcagcagaagcagcagccagggcaccgugagcaccgugcccaaggaggugcuggacagcuggaccggcgccuucaacaccagaagacagccccuguucgcccacaucagaaccagaggcgagagcagaguguga

SEQ ID NO: 26443 - RNA, 765 nt, Artificial Sequence
  derived and/or modified sequence opt4 from capsid_protein_VP2__Norovirus__ALE30634
auggccggcgccuucaucgccggccuggccggcgacaugcugaccaacaccgugggcagccuggugaacgccggcgccggcgccaucaaccagaagguggacuucgagaacaacaaguaccugcagaacgccagcuucaaccacgacaaggagaugcugaacgcccagaucgaggccaccaagagacugcaggccgacaugaucgccaucaagcagggcgugcugaccgccggcggcuucagccccaccgacgccgccagaggcgccaucaacgcccccaucaccaaggugcuggacuggagcggcaccagauacugggcccccaacgccaccagcaccaccagcaugagcggcggcuucaccggccaggccgugcacagagccacccccaacuucaagaccaaccaggcccccaagagcacccccagcagcggcagcagcgugagaagcagcagcacccagcugaccaaccugagcagccacagcagcggcagcagcagaagcagcggcagcaccauggugagcagccugcccagcagcagcagaaccagagacugggugaaccagcagaacuucaaccuggagccccacaugcccggcagccugagaaccgccuucgugaccccccccagcagcaccgccagcagccuggacaccgugagcaccgugcccaagagcgugcuggacagcuggacccccgccuucaacaccagaagacagccccuguucgcccaccugagaagaagaggcgagagcaacaucuga

SEQ ID NO: 26444 - RNA, 765 nt, Artificial Sequence
  derived and/or modified sequence opt4 from capsid_protein_VP2__Norovirus__ALE30636
auggccggcgccuucaucgccggccuggccggcgacaugcugaccaacaccgugggcagccuggugaacgccggcgccggcgccaucaaccagaagguggacuucgagaacaacaaguaccugcagaacgccagcuucaaccacgacaaggagaugcugaacgcccagaucgaggccaccaagagacugcaggccgacaugaucgccaucaagcagggcgugcugaccgccggcggcuucagccccaccgacgccgccagaggcgccaucaacgcccccaucaccaaggugcuggacuggagcggcaccagauacugggcccccaacgccaccagcaccaccagcaugagcggcggcuucaccggccaggccgugcacagagccacccccaacuucaagaccaaccaggcccccaagagcacccccagcagcggcagcagcgugagaagcagcagcacccagcugaccaaccugagcagccacagcagcggcagcagcagaagcagcggcagcaccauggugagcagccugcccagcagcagcagaaccagagacugggugaaccagcagaacuucaaccuggagccccacaugcccggcagccugagaaccgccuucgugaccccccccagcagcaccgccagcagccuggacaccgugagcaccgugcccaagagcgugcuggacagcuggaccagcgccuucaacacccacagacagccccuguucgcccaccugagaaagagaggcgagagcaacguguga

SEQ ID NO: 26445 - RNA, 780 nt, Artificial Sequence
  derived and/or modified sequence opt4 from capsid_protein_VP2__Norovirus__BAR42290
auggccggcgccuucaucgccggccuggccggcgacaugcugaccagcagcgugggcagccuggugaacgccggcgccaacgccaucaaccagaagaucgacuucgagaacaacaagcagcugcagagcgccagcuuccagcacgacaaggagaugcugcaggcccaggugagagccaccaagcagcugcagagcgagaugaucgcccugaagcagggcgugcuggccgccggcggcuucagccccaccgacgccgccagaggcagcaucggcgcccccaugaccaaggugcuggacuggagcggcaccagauacugggcccccaacagcaccaagaccaccggcuacagcggccaguucaccagcagccccgugcacaugagcagccccaacgccccccagagcaagcccgccaagcccagaagccuggcccccagcagcagcagcagcagcguguacagcauguacacccagagcacccaccugaccagcggcagcagcagcaacgccagcagcgccagcaccaagcugaccagccugagcagcggcagcagccagaacagaaccgccgagugggugaaccagcagagaagccugagccccuucaugagcggcgcccugaacaucagccacgugaccccccccagcagcagagccagcagcagcggcaccgugagcaccgugcccaaggaggugcuggacagcuggaccagcgccuucaacacccacagacagccccuguucgcccaccugagagugagaggcgagagcagaguguga

SEQ ID NO: 26446 - RNA, 780 nt, Artificial Sequence
  derived and/or modified sequence opt4 from capsid_protein_VP2__Norovirus__BAR47617
auggccggcgccuucaucgccggccuggccggcgacaugcugaccagcagcgugggcagccuggugaacgccggcgccaacgccaucaaccagaagaucgacuucgagaacaacaagcagcugcagagcgccagcuuccagcacgacaaggagaugcugcaggcccaggugaaggccaccaagcagcugcagagcgagaugaucgcccugaagcagggcgugcuggccgccggcggcuucagccccaccgacgccgccagaggcgccaucggcgcccccaugaccaaggugcuggacuggagcggcaccagauacugggcccccaacagcaccaagaccaccggcuacagcggccaguucaccagcagccccgugcacaugcccagccccaacgccccccagagcaagcccgccaagcccagaagccuggcccccagcagcagcagcagcagcguguacagcaugagcacccagagcacccaccugaccagcggcagcagcagcaacgccagcagcgccagcaccaagcugaccaaccugagcagcggcagcagccagaacagaaccgccgagugggugaaccagcagagaagccugagccccuucaugagcggcgcccugaacaucagccacgugaccccccccagcagcagagccagcagcagcggcaccgugagcaccgugcccaaggaggugcuggacagcuggaccagcgccuucaacacccacagacagccccuguucgcccaccugagagugagaggcgagagcagaguguga

SEQ ID NO: 26447 - RNA, 780 nt, Artificial Sequence
  derived and/or modified sequence opt4 from capsid_protein_VP2__Norovirus__BAR63716
auggccggcgccuucaucgccggccuggccggcgacaugcugaccagcagcgugggcagccuggugaacgccggcgccaacgccaucaaccagaagaucgacuucgagaacaacaagcagcugcagagcgccagcuuccagcacgacaaggagaugcugcaggcccaggugaaggccaccaagcagcugcagagcgagaugaucgcccugaagcagggcgugcuggccgccggcggcuucagccccaccgacgccgccagaggcgccaucggcgcccccaugaccaaggugcuggacuggagcggcaccagauacugggcccccaacagcaccaagaccaccggcuacagcggccaguucaccagcagccccgugagaaugcccagccccaacgccccccagagcaagcccgccaagcccagaagccuggcccccagcagcagcagcagcagcguguacagcaugagcacccagagcacccaccugaccagcggcagcagcagcaacgccagcagcgccagcaccaagcugaccaaccugagcagcggcagcagccagaacagaaccgccgagugggugaaccagcagagaagccugagccccuucaugagcggcgcccugaacaucagccacgugaccccccccagcagcagagccagcagcagcggcaccgugagcaccgugcccaaggaggugcuggacagcuggaccagcgccuucaacacccacagacagccccuguucgcccaccugagagugagaggcgagagcagaguguga

SEQ ID NO: 26448 - RNA, 780 nt, Artificial Sequence; identical to SEQ ID NO: 26446
  derived and/or modified sequence opt4 from capsid_protein_VP2__Norovirus__BAR63719

SEQ ID NO: 26449 - RNA, 780 nt, Artificial Sequence; identical to SEQ ID NO: 26446
  derived and/or modified sequence opt4 from capsid_protein_VP2__Norovirus__BAR63722

SEQ ID NO: 26450 - RNA, 807 nt, Artificial Sequence
  derived and/or modified sequence opt4 from capsid_protein_VP2__Norovirus__BAS02084
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagagacugcagcaggagaugaugaaggugaagcaggccaugcugcuggagggcggcuucagcgagaccgacgccgccagaggcgccaucaacgcccccaugaccaaggcccuggacuggaacggcaccagauacugggcccccgacgccagaaccaccaccuacaacgccggcagauucagcaccccccagcccagcggcgcccugcccggcagagccaaccugagagacgccgugcccgccagaggcagcagcagcaagagcagcaacagcagcaccgccaccagcguguacagcaaccagaccaucagcaccagacugggcagcaccgccggcagcggcaccagcgugagcagcuuccccagcaccgccagaaccagaagcuggguggaggaccagagcagaaaccugagccccuucaugagaggcgcccacaacaucagcuucgugaccccccccagcagcagaagcagcagccagggcaccgugagcaccgugcccagagagauccuggacagcuggaccggcgccuucaacaccagaagacagccccuguucgcccacaucagaaagagaggcgagagcagaguguga

SEQ ID NO: 26451 - RNA, 627 nt, Artificial Sequence
  derived and/or modified sequence opt4 from capsid_protein_VP2__Norovirus__CRL46953
auggcccaggccaucaucggcgccaucgccgccagcgccgccggcagcgcccugggcgccggcauccaggccggcgccgaggccgcccugcaggcccagagauaccagcaggaccugacccugcagcagaacagcuucaaccacgacaaggagaugcugggcuaccagguggagaugagcaacaagcugcuggccaagaaccugaacaccagauacagccugcugcaggccggcggccugagccccagcgacgccgccagagccguggccggcgcccccgugaccagacugguggacuggggcggcgugagaguggccgccccccagagcagcgccaccacccugagaagcggcaacuucauggccgugccccugcccgcccagcccaagcagaagccccuggccagcgagggcuacagcaaccccgccuacgaccccaugcagagaaccgccagcugggugcagagccagaacagcagcagaaacuggagccccuaccacagacaggcccugcagaccgugugggugaccccccccggcagcaccagcagcagcagcgugagcaccgcccccagaggcuacuucaacaccgacagacugccccuguucgccaaccugagaagauga

SEQ ID NO: 26452 - RNA, 630 nt, Artificial Sequence
  derived and/or modified sequence opt4 from capsid_protein_VP2__Norovirus__CRL46956
auggcccaggccgugaucggcgccaucgccgccagcgccgccggcagcauccugggcgccggcauccaggccggcgccgaggccggccugcaggcccagagauaccagcaggaccugcagcugcagcagaacagcuucaagcacgacaaggagaugcugggcuaccaggugcaggccagcaacgcccugcuggccaagaaccugaacaccagauacgcccugcugcaggccggcggccugagcagcgccgacgccgccagagccguggccggcgcccccgugaccagaaucguggacuggaacggcaccagaaucgccgcccccgccagcagcgccaccacccugagaagcggcggcuucauggccgugcccaucccccugagcagcaagaccaagcagcccgugaugagcggccaggacaaccccaacuacgccgccagcagcaucagcagaaccgccagcugggugcagagccagaacagcaugagaagcgugagccccuuccacagcgacgcccugagaaccgugugggugaccccccccggcagcagcagcaccagcagcgugcagagcagcuucuacggcguguucaacaccgacagacugccccuguucgccaacagaagauga

SEQ ID NO: 26453 - RNA, 807 nt, Artificial Sequence
  derived and/or modified sequence opt4 from capsid_protein_VP2__Norovirus__CRL46959
auggccggcgccuucuucgccggccuggccagcgacgugcugggcagcggccugagcagccugaucaacgccggcgccggcgccaucaaccagaagaucgacuucgagaacaacagaaagcugcagcaggccagcuuccaguucagcagcaaccugcagcaggccagcuuccagcacgacaaggagaugcugcaggcccagguggaggccaccaagaagcugcagcaggagaugaugaaggugaagcaggccauccugcuggagggcggcuucagcgccaccgacgccgccagaggcgccaucaacgcccccaugaccaaggugcuggacuggaacggcaccagauacugggcccccgacgccagaaccaccaccuacaacaccggccacuucagcaccccccagagcagcggcgcccugcccggcagaaccaaccccagaauccccacccccgccagagccagcagcagcaccagcagcaacgccagcaccgccaccagcaucagcagcaaccagaccgugagcaccagacugggcagcaccgccggcagcggcaccaacgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaagggcgugcuggacagcuggaccggcgccuucaacaccagaagacagccccuguucgccuacacccacagaagaggcgagagcagaguguga

SEQ ID NO: 26454 - RNA, 807 nt, Artificial Sequence
  derived and/or modified sequence opt4 from capsid_protein_VP2__Norovirus__CRL46962
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccaugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagagccaaccugagagacgccgugcccgccagaggccccagcagcaaguucagcaacagcagcaccgccaccagcguguacagcaaccagaccaucagcaccagacugggcagcaccgccggcagcggcaccagcgugagcagccugcccagcaccgccagaaccagaagcuggguggaggaccagagcagaaaccugagccccuucaugggcggcgcccacaacaucagcuucgugaccccccccagcagcagaagcagcagccagggcaccgugagcaccgugcccaaggagauccuggacagcuggaccggcgccuucaacaccagaagacagccccuguucgcccacaucagaaagagaggcgagagcagaguguga

SEQ ID NO: 26455 - RNA, 807 nt, Artificial Sequence
  derived and/or modified sequence opt4 from capsid_protein_VP2__Norovirus__CRL46965
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcaaccugcagcaggccagcuuccagcacgacaaggagaugcugcaggcccagaucgaggccaccaagaagcugcagcaggagaugaugaaggugaagcaggccgugcugcuggagggcggcuucagcgagaccgacgccgccagaggcgccaucaacgcccccaugaccaaggcccuggacuggagcggcaccagauacugggcccccgacgccagaaccaccaccuacaacgccggcagauucagcaccccccagcccagcggcgcccugcccggcagagccaaccugagagacgccgcccccgccagaggcagcagcagcaagagcagcaacagcuucaccgccaccagcguguacagcaaccagaccaccagcaccagacugggcagcaccgccggcagcggcaccagcgugagcagccugcccagcaccgccagaaccagaagcuggguggaggaccagagcagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaagaagaggcgagagcagaguguga

SEQ ID NO: 26456 - RNA, 777 nt, Artificial Sequence
  derived and/or modified sequence opt4 from capsid_protein_VP2__Norovirus__CRL46968
auggccggcgccuuccuggccggccuggugggcgacgccaucaccagcggcgugggcagccugaucaacgccggcgccaacgccaucaaccagaagguggaguacgacuucaacaagcagcugcagcuggccagcuucaagcacgacaaggagaugcugcagagccaggugcuggccaccaagcagcugcagcaggagaugaugaacaucagacagggcgugcugagcgccggcggcuucagccccaccgacgccgccagaggcgccgugaacgcccccaugaccaagauccuggacuggaacggcaccagauacuucgcccccaacagcaugaagaccaccagcuacagcggccaguucagcagcaaccccgugcacagacagcccaccagccccagaagcgacccccccaagaucaaggugaacagcgacagcgccagcguguacagcagcgccagcagcgcccccagccagagcacccacagcaccgcccugaccgccggcagcagcagcagcagaaccaccagcagcagcgccgccgccagcacccugagcagaaccagcgacugggugagaggccagaacgagagacugagccccuucauggacggcgcccugcagaccaccuucgugaccccccccagcagcaaggccagcagcuacggcagcgugagcaccgugcccaaggccgugcuggacagcuggacccccauguucaacacccacagacagccccuguucgcccacgugagaagaagaggcgagagccagaucuga

SEQ ID NO: 26457 - RNA, 765 nt, Artificial Sequence
  derived and/or modified sequence opt4 from capsid_protein_VP2__Norovirus__CRL46971
auggccggcgccuucaucgccggccuggccggcgacaugcugaccaacaccgugggcagccuggugaacgccggcgccaacgccaucaaccagaccaucgaccuggagaacaacaaguaccugcagaacgccagcuucaaccacgacaaggagaugcugaacgcccagaucgaggccaccaagaagcugcaggccgacaugaucgccaucaagcagggcgugcugaccgccggcggcuucagccccaccgacgccgccagaggcgccaucaacgcccccaugaccaaggugcuggacuggaacggcaccagacacugggcccccggcgccaccagcaccaccagcaugagcggcggcuucacccaccagaccgugcacagaagcacccccaacuucaagaccaaccaggcccccaagagcacccccagcagcggcagcagcgugagaagcaacagcacccagaucaccagccugagcagccacagcagcggcagcagcagaagcagcggcagcaccgugaucagaagcauccccagcagcgacagaaccagagacugggugaaccagcagaacuucaaccuggagccccacaugcccggcagccugagaaccgccuucgugaccccccccagcagcaccgccagcagcagcggcaccgugagcaccgugcccaagaacgugcuggacagcuggaccagcgccuucaacaccagaagacagccccuguucgcccaccugagaagaagaggcgagagcaacguguga

SEQ ID NO: 26458 - RNA, 771 nt, Artificial Sequence
  derived and/or modified sequence opt4 from capsid_protein_VP2__Norovirus__CRL46974
auggccggcgccuucguggccggccuggccggcgacaucgugaccaacagcaucggcagccuggugaacgccggcgccaacgccaucaaccagaagguggacuucgagaacaacaagcagcugcagcaggccagcuucaaccacgaccaggagaugcugcaggcccagauccaggccaccaagcagcugcaggccgacaugaucgcccugagacagggcgugcugaccgccggcggcuucagccccaccgacgccgccagaggcgccgugaacgcccccaugacccaggugcuggacuggagcggcaccagauacugggcccccggcgccaccaagaccaccgccuucagcggcggcuucaccagcagccccaacaccagaaccaucgugcccaagaagaccagcgccacccccgccagcaccagcgugagcagacccagcagccuggccagcaccgccagcaccagaagcaccuucgugagcggcaccagcagccugagcagcagcaccagaagcagcuucaacagccagcccaccagcagcagcagcagaaccagcgagugggugagaagccagaacagagugcuggagcccuacaugagaggcagccugcagaccgccuucgugaccccccccagcagcagagccagcagcaacggcaccgugagcaccgugcccaaggaggugcuggacagcuggaccagcguguucaacacccacagacagccccuguucgcccaccugagaagaagaggcgagagccagguguga

SEQ ID NO: 26459 - RNA, 807 nt, Artificial Sequence
  derived and/or modified sequence opt4 from capsid_protein_VP2__Norovirus__CRL46977
auggccggcgccuucuucgccggccuggccagcgacgugcugggcagcggccugggcagccugaucaacgccggcgccggcgccaucaaccagaagguggaguucgagaacaacagaaagcugcagcaggccagcuuccaguucagcagcagccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgcccccgccagaggcagcagcagcaugagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagagccuga

SEQ ID NO: 26460 - RNA, 807 nt, Artificial Sequence
  derived and/or modified sequence opt4 from capsid_protein_VP2__Norovirus__CRL46980
auggccggcgccuuccuggccggccuggccagcgacgugcugggcagcggccugggcagccugaucaacgccggcgccggcgccaucaaccagaagguggaguucgagaacaacagaaagcugcagcaggccagcuuccaguucagcagcagccugcagcaggccagcuuccagcacgacaaggagaugcugcaggcccagaucgaggccaccaagaagcugcagcaggagaugaugagagugaagcaggccaugcugcuggagggcggcuucagcgagaccgacgccgccagaggcgccaucaacgcccccaugaccaagacccuggacuggagcggcaccagauacugggcccccgacgccagaaccaccaccuacaacgccggcagauucagcaccccccagcccagcggcgcccugcccggcagagccaaccugagagccaccgcccccgccagaggcagcagcagcaugagcagcaacagcagcaucgccaccagcguguacagcaaccagaccaccagcaccagacugggcagcaccgccggcagcggcaccagcgugagcagccugcccagcaccgccagaaccagaagcuggguggaggaccagaacagaaaccugagccccuucaugagaggcgcccacaacaucagcuucgugaccccccccagcagcagaagcagcagccagggcaccgugagcaccgugcccaaggaggugcuggacagcuggaccggcgccuucaacaccagaagacagccccuguucgcccacaucagaaagagaggcgagagcagagccuga

SEQ ID NO: 26461 - RNA, 1623 nt, Artificial Sequence
  derived and/or modified sequence opt5 from capsid_protein_VP1__Norovirus__ABY65350
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucagucuagcacagacaccgaaaacgauuucgagacccaucaaaauacaaaguuuacccccgugggagucauucaggacggcuccacaacgcaccgcaacgaaccccagcaaugggugcugccuagcuacucuggcagaaauguucacaacgugcaucuugccccggcugucgcccccaccuucccuggggagcagcugcucuuuuuccgguccacagugcccggauguagcggcuauccuaauauggaucuggacugccugcucccccaggagugggugcagcacuuuuaccaagaagcggcuccugcccagucugauguugcccugcuucgcuucgucaaccccgacaccgggagagugcuguuugaguguaaacuccauaagagcggauaugugacagucgcucacaccggccagcacgaucuggugaucccgccuaacggguacuuccgguuugacuccuggguuaaucaguucuauacgcuugcccccaugggcaacggaaccggcagacgccgggcucuguga

SEQ ID NO: 26462 - RNA, 1623 nt, Artificial Sequence
  derived and/or modified sequence opt5 from capsid_protein_VP1__Norovirus__ACO55068
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccgcggaagagauuccugcuccccuggggacgccggauuucgugggaagaauccagggcguccuuacccagacaacccgcggggacggauccacacggggccauaaagccaccgugagcacgggggacguucacuuuacaccuaagcugggaucuauucaauucaacaccgauaccaauaacgacuuugaaacaggccagaauaccaaguucacacccgugggcgucgugcaggaugggaacggaacgcaccaaaaugagccccagcaguggguucucccuuccuacagcggcagaaccgggcauaacgugcaccuggccccggccgucgcucccacauuuccuggagaacagcuucuguucuuucgguccaccaugcccggcuguucuggguacccuaacaugaaucucgacugccugcugccccaagagugggugcagcauuucuaucaggaggccgcgccugcucagagcgauguggcccuccugcgcuuuguuaaccccgacacaggcagaguccuuuucgaauguaaacugcacaaguccggauacgugaccguggcccacacgggccaacaugaucucgucaucccgccuaauggguauuuucgguucgacagcugggugaaccaguucuacacccuggcucccaugggaaauggcacagggagacgccgggcccuuuga

SEQ ID NO: 26463 - RNA, 1623 nt, Artificial Sequence
  derived and/or modified sequence opt5 from capsid_protein_VP1__Norovirus__ADI45808
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgagaaucauugucgacgugcggcaacucgagccugugcugaucccccugccugauguccgcaauaacuuuuaucauuacaaucagucuaacgaccccaccauuaagcucaucgcuaugcuguauacaccccuuagagccaacaaugcuggcgaugacguuuucaccgugagcugccgggugcugacacgcccuuccccggauuuugacuucauuuuucucgugcccccuaccgucgaaagcagaacgaaacccuucaccguuccuauccugacaguggaggaaaugaccaacucucgguuucccauuccgcuugagcgccuguacacagggccuuccagcgccuucgucgugcagccccagaauggaagauguaccacggauggcguucuccuggggacaacccaacugucugccgugaacaucugcacauuccggggagacgucacccacaucgcuggcucccgcaauuauaccaugaaccucgcgagccagaauuggaacaauuacgauccuacagaggaaauucccgccccucugggcacgcccgacuuuguggggaagauccagggaaugcuuacccagacaaccagaucugacggcuccacacgggggcauaaagcuaccguccugacgggaagcgccgauuucgccccgaagcucggccgcgugcaauuugcuacagacaccgauaacgacuucgaguccgggcagaauaccaaguuuacaccuguuggagugauucaggauggcucuaccacacacagaaacgaaccccaacaguggguccugcccaauuacagcggccggacggggcauaacgugcaccuugccccugcgguugcuccgaccuaucccggagagcagcuccuguucuuuagauccacaaugccuggcuguagcggguaccccaauauggaccuggauugccugaucccucaggacugggugcaacacuucuaucaggaagccgcccccgcucagucugaugucgcccuccugcgcuuugugaacccugacaccggacgggugcuuuucgaguguaaacugcauaaguccggcuacguuacagucgcucacaccgggcagcaugaucucgugauucccccgaacggcuauuuuagauucgacagcugggugaaucaauuuuacacgcuggccccuaugggaaacggcaccgggcgccggagagcgcuuuga

SEQ ID NO: 26464 - RNA, 1623 nt, Artificial Sequence
  derived and/or modified sequence opt5 from capsid_protein_VP1__Norovirus__ADI45811
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauuccuuggucugcgccgcugggccccgaucuuaacccuuaccugagccaccucgcccgcauguauaauggguacgcuggaggcuucgaaguccaggugauccuggccggcaacgcuuuuacggccgggaaaauuaucuucgcggccguucccccuaauuuucccaccgagggacuuuccccgucucaggugacaauguucccucauaucauugucgacgugagacaacuggagcccgugcucaucccucugcccgauguccggaacaauuuuuaucacuacaaccagagcaaugaccccaccauuaagcugaucgcuaugcucuauacaccucugcgcgccaacaacgcuggcgaugacguuuucaccguguccugcagagugcuuacacggccgagccccgauuuugacuucauuuuucuggucccucccaccguggaaucucgcacgaaaccuuucuccguucccauccucaccguggaggaaaugacaaauagcagauuuccgauuccucuggagaaacuuuucaccgggcccucuuccgccuucgucgugcagccucagaacggacgguguacaaccgauggcguucugcucgggacgacacaacugagccccgugaauaucugcaccuuucgcggagacgucacacauaucaccggcucuagaaacuacaccaugaaucuggccacacagaacuggaacuccuaugauccuacggaggaaauucccgcuccgcucggcaccccugacuucguggggaagauccagggaguccugacacagaccacacgggcggacggcagcacccgcgggcacaaggccacgguguacacaggauccgcugauuuugcccccaaacuuggcagaguucaauucgccaccgacaccgauaaugacuuugaugcuaaucagaacacaaaguucacccccgugggggucauucaggacggagauacagcccaucggaaugagccucaacagugggugcugccgucuuacagcggccgcaacucccacaauguucaccucgcgcccgcuguggccccuacguuucccggcgaacagcugcuuuucuuuagaagcaccaugccuggguguucuggauaucccaacauggaccuggauugccuccugccucaggaguggguccaauacuucuaucaggaagccgcucccgcccaguccgacguggcucugcuccgguuugugaauccggauacaggcagaguucuguucgaguguaaacuucauaagagcggguacgucaccguggcccacacaggacagcaugaccuggugaucccucccaacggcuauuuucgcuucgacucuugggucaaccaauucuacacccucgcgccuauggggaauggcacgggacggagacgcgcccuguga

SEQ ID NO: 26465 - RNA, 1623 nt, Artificial Sequence
  derived and/or modified sequence opt5 from capsid_protein_VP1__Norovirus__ADI45812
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuuaccccuaagcugggcagaguucaauucgccaccgacacagauaaugacuuugaugccaaucagaacaccaaauucacacccgugggggucauucaggacggaaauacggcucaucggaacgagccccaacagugggugcucccuucuuacagcggccgcaauucccacaacguucaccuggccccggcgguggcucccaccuuuccuggcgaacagcuucuguucuuuagaagcacaaugcccggguguucuggauauccuaauauggaucucgacugccugcugccccaggaguggguccaauacuucuaucaggaagccgccccugcucaguccgauguggcccuccugcgguuugugaaccccgacaccggcagaguucuuuucgaguguaagcugcauaaaagcggguacgucacaguggcucacaccggacagcaugaucucgugaucccgccuaacggcuauuuucgcuucgacucuugggucaaucaauucuacacgcuggcccccauggggaacggcaccggacggagacgcgcgcuuuga

SEQ ID NO: 26466 - RNA, 1623 nt, Artificial Sequence
  derived and/or modified sequence opt5 from capsid_protein_VP1__Norovirus__ADI45814
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucuagaaacuacaccaugaaucucgcuacccagaacuggaacuccuaugaucccacagaggaaauuccugcgccccugggcacgccggacuucguggggaaaauccagggaguccuuacccagacaacccgggccgacggcagcacacgcgggcacaaggcuaccguguacacgggauccgccgauuuugccccuaagcugggcagaguucaauucgcuacagacaccgauaaugacuuugaugccaaucagaacaccaaauucacacccgugggggucauucaggacggagauaccgcgcaucggaaugagccccaacagugggugcucccuucuuacagcggccgcaacucccacaauguucaccuggcuccggccguggcccccacauuuccuggcgaacagcuucuguucuuuagaagcacgaugcccggguguucuggauauccuaacauggaccucgauugccugcugccccaggaguggguccaauacuucuaucaggaagcugccccugcucaguccgacguggcccuccugcgguuugugaaucccgauaccggcagaguucuuuucgaguguaagcugcauaaaagcggguacgucacaguggcgcacaccggacagcaugaccucgugaucccgccuaacggcuauuuucgcuucgacucuugggucaaccaauucuacacacuggcccccauggggaauggcaccggacggagacgcgcucuuuga

SEQ ID NO: 26467 - RNA, 1623 nt, Artificial Sequence
  derived and/or modified sequence opt5 from capsid_protein_VP1__Norovirus__ADI45815
augaagauggccagcuccgacgcuaaccccuucgauggcucuaccgccaaucuggugccugaggucaacaaugaaguuauggcgcucgagccgguggugggggcugccaucgccgcucccgucgccggacagcaaaacgugauugacccuuggaucagaaauaacuuuguucaggcucccggcggggaguucacagugagcccucggaaugcccccggagaaauucugugguccgcgccucuuggcccggaucugaaccccuaccucucucaccuggcccgcauguauaauggguacgcuggaggcuuugaaguccaggugauccuugccggcaacgcuuucacggccgggaaaauuaucuuugcggccguuccucccaauuucccuaccgagggacugagccccucccaggugacaauguuuccgcauaucauugucgacgugagacaacucgagccugugcugaucccccugccugauguccggaacaauuucuaucacuacaaccagucuaaugaccccaccauuaagcucaucgcuaugcuguauacaccccuucgcgccaacaacgcuggcgaugacguuuuuaccgugagcugcagagugcugacacggccuuccccggauuucgacuuuauuuuccucgugcccccuaccgucgaaagccgcacgaaacccuuuucuguuccuauccugaccguggaggaaaugacaaauuccagauuccccauuccgcuugagaagcuguucaccgggccuagcucugccuuugucgugcagccccagaacggacgguguacaaccgauggcguucuccuggggacgacacaacuguccccugugaauaucugcaccuuccgcggagacgucacacauaucaccggcagcagaaacuacaccaugaaucucgccacacagaacuggaacucuuaugaucccacggaggaaauuccugcuccccugggcaccccggacuuuguggggaaaauccagggaguccuuacacagaccacacgggcggacggcuccacccgcgggcacaaggccacgguguacacaggaagcgcugauuucgccccuaagcugggcagaguucaauuugccaccgacaccgauaaugacuucgaugcuaaucagaacacaaaauuuacccccgugggggucauucaggacggaaauacagcccaucggaacgagccccaacagugggugcucccuuccuacucuggccgcaauagccacaacguucaccuggcgccggcuguggcccccacguucccuggcgaacagcuucuguuuuucagauccaccaugcccggguguagcggauauccuaauauggaucucgacugccugcugccccaggaguggguccaauacuuuuaucaggaagccgcuccugcccagucugauguggcucuccugcgguucgugaaccccgacacaggcagaguucuuuuugaguguaagcugcauaaauccggguacgucaccguggcccacacaggacagcaugaucucgugaucccgccuaacggcuauuuccgcuucgacagcugggucaaucaauuuuacacccuggcgcccauggggaacggcacgggacggagacgcgcccuuuga

SEQ ID NO: 26468 - RNA, 1623 nt, Artificial Sequence
  derived and/or modified sequence opt5 from capsid_protein_VP1__Norovirus__ADI45816
augaagauggccagcaacgacgcuaaucccuccgauggcucugccgcgaaccuggugccugagaucaauaacgaagucauggcucucgagccgguugugggggccgccauugcugcccccguggcuggacagcaaaaugucaucgacccuuggauuagaaacaauuucgugcaggcccccggcggggaauuuaccguuagcccucggaacgcgcccggagagauccugugguccgccccucuuggcccggaucugaaucccuaccucucucaccuggcucgcauguauaacggguacgccggaggcuucgaagugcaggucauuccugcuggcaaugccuuuacagcggggaaaaucaucuucgccgcugugcccccuaacuuucccacggagggacuuagcccgucccagguuaccauguucccucauauuaucguggacgucagacaacuggagcccgugcucauuccucugcccgaugugcggaauaacuuuuaucacuacaaucagucuaacgacagcacaaucaagcugauugccaugcucuauacaccccugcgcgcuaacaaugccggcgaugacgucuucaccguuuccugcagagugcuuacccggccuagcccggauuuugacuucaucuuucuggugcccccuacagucgaaucucgcaccaaacccuucacggugccuauucucaccguugaggaaaugacaaacuccagauuucccaucccgcuggagaaacuuuucaccgggccuagcucugccuucgugguccagccccagaauggacgguguacaaccgauggcgugcugcucgggacgacacaacuguccccuguuaacaucugcaccuuucgcggagacgugacacauauugcuggcagcagaaauuacaccaugaaccuggcgucucucaauuggaacaauuaugaucccaccgaggaaaucccugcuccccugggcacaccggacuucgucgggaagauucagggagugcuuacgcagaccacaaaggaggacggcuccacccgggggcacaaggccacagucuacaccggaagcgccgauuuuacgccuaaacugggcuccgugcaguucgggacagacaccgaaaacgauuuugagacccaucaaaauacaaaguucacccccguuggagugauccaggacggcucuacaacgcaccgcaacgaaccccagcaauggguccucccuagcuacuccggcagaaaugugcacaacguucaucuggccccggcuguggcccccaauuuuccuggggagcagcuucuguucuuucggagcaccaugcccggauguucuggcuauccuaacauggaucucgacugccugcugccccaggaguggguccagcacuucuaccaagaagcggcuccugcccaguccgauguggcccuccugcgcuuugugaaccccgacacagggagaguucuuuucgaguguaaacugcauaagagcggauaugucaccguggcucacacaggccagcacgaucucgugauuccgccuaauggguacuuucgguucgacucuugggucaaccaguucuauacccuggcccccaugggcaauggaacgggcagacgccgggcucuuuga

SEQ ID NO: 26469 - RNA, 1623 nt, Artificial Sequence
  derived and/or modified sequence opt5 from capsid_protein_VP1__Norovirus__ADI45817
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucccgucccucccaccguggaaagccgcacgaaaccuuucaccguucccauccucacaguggaggaaaugaccaacucuagauuuccgauuccucuggagcggcuuuacacagggcccuccagcgccuucgucgugcagccucagaauggacgcuguaccacggauggcguucugcucgggacaacccaacugucugccgugaacaucugcacauucagaggagacgucacccauaucgcuggcucccggaauuauaccaugaaccuggcgagccagaauuggaacaauuacgaucccacagaggaaauuccugcuccccucggcacgccggacuuuguggggaagauccagggaaugcugacccagacaacccgcucugacggcuccacaagagggcacaaagccaccguccuuacgggaagcgccgauuucgccccuaagcugggccgggugcaauuugcuacagacaccgauaacgacuucgaguccgggcagaauaccaaguuuacacccguuggagugauucaggauggcucuaccacacaucgcaacgaaccccaacaguggguccucccuaauuacagcggcagaacggggcacaacgugcaccuggccccggcgguugcucccaccuauccuggagagcagcuucuguucuuucgguccacaaugcccggcuguagcggguacccuaauauggaccucgauugccugcugccccaggaaugggugcaacauuucuaucaggaggccgccccugcucagucugacgucgcccuccugagauuugugaaccccgauaccggacgcgugcuuuucgaguguaaacugcacaaguccggcuacguuacagucgcucauaccgggcagcacgaccucgugaucccgccuaacggcuauuuucgguucgauagcugggugaaucaauuuuacacgcuggcccccaugggaaacggcaccgggagacgccgggcggucuga

SEQ ID NO: 26470 - RNA, 1623 nt, Artificial Sequence
  derived and/or modified sequence opt5 from capsid_protein_VP1__Norovirus__ADI45818
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacauccccggcucuagaaauuacaccaugaaccucgccucccagaauuggaacagcuaugauccuaccgaggaaauccccgcuccgcugggcacaccugacuucgucgggaaaauucagggagugcuuacgcagaccacacggaccaauggcuccacacgcgggcauaaggcgaccguuuacacgggaucugccgacuuuagccccaagcugggcagagugcaauucgcuacagauaccgacaacgauuuugagaccaaucagaacacaaaauucacccccgucggggugauccaggacggauccacaacgccucggaaugaaccgcaacaguggguucuccccagcuacucuggccgcaacauucacaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcauaaaagcggguacgugacaguggccuauaccggacagcacgaucucgucauucccccuaacggcuacuuucgcuucgacuccugggugaaccaauucuauacgcuggcucccauggggaauggcaccggacggagacgcgcccuuuga

SEQ ID NO: 26471 - RNA, 1626 nt, Artificial Sequence
  derived and/or modified sequence opt5 from capsid_protein_VP1__Norovirus__AET79296
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggugcuucagccccggcugugcacccaugcccgcuggccugcucccguuuacggccuccugguggacccuucccuucccagcaauccgcaauggcagaacgggagaguccacguggauggaacacugcucggcaccacgccuguuucuggcuccugggugagcuguuucgcggccgaagcugccuaugaguuucagucugggacaggagaggucgccaccuucacacugauugaacaagacggcuccgcuuacgugcccggggaucgggccgcgccucugggauaccccgacuuuagcggccagcucgagaucgaaguccagaccgagaccacaaaggcuggggacaaacugaaggugacgaccuucgaaaugauucuuggaccuacaaccaauguugaucaggcccccuaucaaggccgcgugcaugccuccacaucugucaccgcuagccugaaccucguggacggcagaguucgggccgugccgcgcuccaucuacagcuuccaggaugucgugccugaguauaaugacgggcugcuugugccccuggcucccccuauuggaccguuucuccccggcgagguucugcugagauuccggacguacaugagacagaucgauucuuccgacgccgcggccgaagcuaucgauugcgcccucccucaggaguuuauuagcugguucgcuucuaacgccuuuacaguccaaagcgaagcgcugcuucugcgcuaucggaauacccucaccgggcagcugcuguucgaguguaaacuuuacuccgaaggauauaucgcccucucuuacagcggcuccgggccccugacauuuccuaccgacggcuucuuugagguggugagcuggguccccagacuguaccagcucgcuucugugggaucccuggccacaggccgcacgcuuaagcaguga

SEQ ID NO: 26472 - RNA, 1626 nt, Artificial Sequence
  derived and/or modified sequence opt5 from capsid_protein_VP1__Norovirus__AFB18026
augagaaugagcgacggcgccacccccaagccuaacggguccgaggcugccggacaggaucuggugccgucuagcgucgaacaagcgauccccauucagccuguugcuggcgccgccguggcugcccccacagcugggcagaucaaucagauugacccuuggaucuuccaaaacuuugugcagugcccccucggagaguucuccauuucuccucggaauacgccgggcgaaauccuguuugaucuugcccuggggcccggacucaacccuuaccuggcgcaccuuagcgccauguauaccggcugggucggcaauauggaggugcagcugguucucgcugggaacgccuucacagcuggaaaaguggucguggcccugguucccccuuacuuuccccagggcucccugaccacagcgcaaaucaccuguuucccgcaugugaugugcgacguccgcacacucgaaccuauucagcugccccuucuggaugugagacgggugcucuggcacgccacccagaaucaggaggaggcuaugcgccuggucuguaugcuuuauacgccucugagaaccaacucucccggggacgagagcuuuguuguguccggacggcuccugagccgccccucuccugauuucaauuuuguguaccugacaccgcccaucgaaagaaccauuuaucggauggucgaccucccugugguucaaccccgccugugcacacauuccagauggccugcccccguguaccagauccuugucgauccgagccugccuucuaacccccaguggcaaaauggccgggugcucauugacgggacccugcuuggaacgacaccuaucuccagcucuuggguugcuuccuucgccggcaccgccgaauauagcuuucagucucccccuuccgcugagauuggcgaggugagccuguucgaaaucgauggguccgcguacacacccggagaccgcgccgcuccgcucggcuacccugauuuuagcgggacccuggaggucgaaauccagaccgagacaacgaaggccggacagaaacuggacgugcacaccuucaaccucgaacugaagucucaaacagucgaccaggcccccuuccagggcaaaguguauauggaucuugaggcuuccgccagccuggaccucguuaaugggagagugcgggcgucuccccgcagcgucgcugccuuuaaggaugagcugccuuccuacaacucuggacuucuggugccgcucgcucccccucugggccccuuccugccuggcgaaguucuccugagauuucggaccuucgccagacagguggacacaaccgaugccagcgcucaagccgucgacugugcgcuuccccaggagcugguguccugguuugccagcucuaauuucacggugcaguccgaagcucuccugcugcgcuaucggaacacacuuaccgggcagcuccuguuugagugcaagcuguacagcgaaggauauauugcccucucuuacaccggcuccagcccucugacauuccccaccgauggguuucuugagguugucuccugggugccgagacugcaucaacucgcuucugugggaagccuggccacaggccgcucccugaaacaguga

SEQ ID NO: 26473 - RNA, 1626 nt, Artificial Sequence
  derived and/or modified sequence opt5 from capsid_protein_VP1__Norovirus__AFB18027
augagaaugagcgacggcgccacccccaagccuaacggguccgaggcugccggacaggaucuggugccgucuagcgucgaacaagcgauccccauucagccuguugcuggcgccgccguggcugcccccacagcugggcagaucaaucagauugacccuuggaucuuccaaaacuuugugcagugcccccucggagaguucuccauuucuccucggaauacgccgggcgaaauccuguuugaucuugcccuggggcccggacucaacccuuaccuggcgcaccuuagcgccauguauaccggcugggucggcaauauggaggugcagcugguucucgcugggaacgccuucacagcuggaaaaguggucguggcccugguucccccuuacuuucccaagggcucccugaccacagcgcagaucaccuguuucccgcaugugaugugcgacguccgcacacucgaaccuauucaacugccccuucuggaugugagacgggugcucuggcacgccacccaggaccaggaggaggcuaugcgccuggucuguaugcuuuauacgccucugagaaccaauucucccggggaugagagcuuuguuguguccggacggcuccugagccgccccgccucugacuucaacuuuguguaccugacaccuccgaucgaaagaaccauuuaucggauggucgaucuccccgugguucagccucgccugugcacacauuccagauggcccgcuccuguguaccaaauccuugucgaccccagccugccgucuaauccucaguggcagaacggccgggugcaaguugaugggacccuccugggaacgacacccguguccggcagcugggucgccucuuucgccggcaccgcugaauauuccuuucagacaccucccagcgcggagauugggaccaucucccuuuucgagauugacggaucugccuacgugccuggcgaucgcgcugcuccccugggguacccggacagcgccggaacccucgaagucgagauccagacagaaacgaccaaagccggccagaagcugaaugugcacacauuuucccuggagcucguuagccaaaccguggaccaggccccuuaucaggggcagaucuucgucgaucuggaaacaucuuccagcauggaccuugugaacggaagaguucgggcgucuccccgcagcauuuccggcuucaaagaugagcugcccucuuacaauaacggccuccuggugccucuugcuccgccccuggggccuuuucuccccggagagguccugcugagauuccggaccuuugccggccaaguggaccucacggaugccgcugcccagccuguggacugugcucugccccaggaguucguuagcugguuugccuccaauaacuucacaguccagagcgaagcgcuucugcucagauaucgcaacacccugaccgggcaacugcuuuuugaaugcaagcucuacucugagggauauaucgcccuguccuacacaggcagcgggccucugaccuuccccacagauggcuuuuucgaaguggugucuugggucccgcggcucuaucagcuggcuuccgugggaagccuugccacgggcagaucccugaagcaguga

SEQ ID NO: 26474 - RNA, 1635 nt, Artificial Sequence
  derived and/or modified sequence opt5 from capsid_protein_VP1__Norovirus__AFI08231
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcgggaauggaaucaaccugacagagcuuaauggcgaaccuuaucacgccuucgagucccccgccccgauuggguucccugaucugggaggcugcgacuggcaucucaccgcuacacccacccaggcguuuaacgacggggccaagguggucagacugucugugacgcagggagcugccuucgccccucaccuuggcacaauccacuacaccaccacagauaccgacuauaaucccaacacaagcaucauuuguacgcuggauuggcucucccagaccgcuggccaaagcaauguugacccuuggcagauccccacauacgggucuacccugacagaagccgcgcagcuggcuccgccuauuuuuccucccggauucggcgagacccucguguuuuuccuguccgauuuucccaucagcaacgggaagaauggacuuucugucccgugcacgcugccccaggaguucgugacccauuuugucaacgaacaagccccuauucggggcgaggccgcucuccugcacuauguggaccccgauacacaucgcaaucuuggggaguucaaacuguacccugaaggcuuuaugaccuguguucccaacacaagcggaggcgggccucagacccuccccaucaacggaguguucgucuuuguguccuggguuucuagauucuaccagcugaagccggugggcacggccggggcugcccggcgccugggaaucagacggagcuga

SEQ ID NO: 26475 - RNA, 1623 nt, Artificial Sequence
  derived and/or modified sequence opt5 from capsid_protein_VP1__Norovirus__AFI08240
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguggcccugcuucgcuuuguuaaccccgauacaggcagaguccuguucgaguguaaacuccauaaguccggguaugugaccguggcucacacgggccagcacgaccuggucaucccgccuaauggauacuuucgguucgauagcugggugaaccaguucuauacccuugcccccaugggcaacgggacaggaagacgccgggcucuguga

SEQ ID NO: 26476 - RNA, 1620 nt, Artificial Sequence
  derived and/or modified sequence opt5 from capsid_protein_VP1__Norovirus__AFS33552
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggcuucccagaauuggucuaacuacgaccccacagaggaaaucccugcgccccuuggcaccccugacuuugucgggaaaauucagggacugcucacccagacaacgagagccgauggcagcacccgggcucacaaggccacaguguccaccgggagcguucacuucacacccaagcugggaucugugcaauuuaccacggacacaaauaacgauuuccagaccggccagaauaccaaauuuacaccggucggggugauccaagacggagaucaucaccagaacgagccucagcaguggguucuucccaauuacuccggccgcaccggccauaacgugcaccuggcccccgcugucgccccuacauucccgggggaacaacuccuguuuuucagaagcacgaugcccggauguucuggcuauccuaauaugaaccuggacugccuccugccccaggagugggugcuucacuuuuaccaggaagcggcuccugcccagagcgauguggcccugcuccgguucguuaaucccgacaccgggcgcguccuguuugaguguaaacuucauaaguccggauauauuacaguggcucacaccggcccuuacgaucuggugauucccccgaacggguauuucagauuugacucuugggucaaccaauucuacacacucgccccuaugggcaauggaaccggccggagacgcgcucuguga

SEQ ID NO: 26477 - RNA, 1608 nt, Artificial Sequence
  derived and/or modified sequence opt5 from capsid_protein_VP1__Norovirus__AFS33555
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaaacucgucuucgccgcgauucccccucauuuuccccuggaaaaucuuagcccuggacagaucacaauguucccccacgugaucaucgauguuagaacccuggagccggugcuccugccucuucccgacguccggaacaacuuuuuccauuacaaucagcaaccugaaccccgcaugagacugguggccaugcucuauacaccccugcgguccaacggcucuggggaugacguguuuaccgucagcugccgcguucugacaagaccuuccccggauuucgacuuuaauuaccucgugcccccuaccguggagagcaagacgaaacccuucacccugccuauucuuacaaucggagagcugucuaacucccgguuucccgucccgauugaugaacucuauaccagcccuaaugagggcgugaucguucagccccagaacgggcgcucuacacuggacggagaacuucugggcaccacgcagcucgugccuuccaauauuugugcucugagaggccggaucaacgcccaaguccccgaugaccaccaucaguggaaucuccaggugacaaacaccaaugggacaccuuucgaucccaccgaggacguuccggcuccucugggaacccccgacuuccuggccaacauuuacggcgugacaagccagcgcaaucccaacaauacgugcagagcccacgaugggguccuugcuaccuggucuccuaaguuuacaccgaaacugggauccgugauccucggcaccugggaagagagcgaccuggaucuuaaccaacccacacgguucaccccugucgggcuguuuaauacggaccacuucgaucagugggcgcuccccuccuauucuggacgccugacacugaacaugaaccucgccccuagcgugagcccccuguuuccuggcgagcagcuucuguucuuuagaucccauaucccccucaagggcgggaccucugacggagcuauugauugucugcugccgcaagaauggauccagcacuucuaccaggaguccgccccuagccccaccgacguugcccuuauucgguacacaaauccugauaccggcagagugcucuuugaagcuaagcugcaucgccagggguucaucacagucgccaacucuggaagccggcccauugugguuccgccuaauggcuauuuuagauucgacuccugggugaaccaauuuuacucucuggcgcccauggggacgggcaauggacgccggagaguccaguga

SEQ ID NO: 26478 - RNA, 1623 nt, Artificial Sequence
  derived and/or modified sequence opt5 from capsid_protein_VP1__Norovirus__AFW15938
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaaugcccagaacguucaccuugcuccggccguggcgcccaccuuuccuggggagcagcuccuguucuuucggucuacaaugcccggauguuccggcuauccuaauauggaucuggacugccugcucccccaggaguggguccaacauuucuaccaggaagcugccccugcccagagcgauguggcucugcuucgcuuugugaaccccgacaccgggagaguucuguucgaguguaaacuccacaagucuggauaugucacaguggcccauaccggccagcacgaucuggugaucccgccuaacggguacuuucgguucgacagcugggucaaucaauucuauacgcuugcucccaugggcaacggaaccggcagacgccgggcccuguga

SEQ ID NO: 26479 - RNA, 1623 nt, Artificial Sequence
  derived and/or modified sequence opt5 from capsid_protein_VP1__Norovirus__AFW15940
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucuaaaaccaagccuuucacgguucccauccugaccguggaagagaugacaaacucccgcuuuccuauuccccuugagaaacuguucaccgggccgagcucugccuucgucgugcagccucagaauggaagauguacaaccgacggcguucuccuggggacgacacaacugucccccgugaacaucugcaccuuucggggagaugucacacauaucgcuggcagccgcaauuacaccaugaaccucgcgucucugaauuggaacaauuaugacccuaccgaagagauucccgccccucuuggcacacccgauuucguggggaagauccagggaguccugacgcagaccacaaagggcgacggguccaccagaggacacaaagcuacaguguacaccggcagcgccccguuuacgccuaagcucggguccguucaguucucuacagacaccgaaaacgauuuugagacccaucaaaauacaaaauucacccccgugggagucauucaggacggcagcacaacgcaccggaacgaaccccagcaaugggugcugccuuccuacagcggccgcaaugcccagaacguucaccuugcuccggccguggcgcccaccuuuccuggggagcagcuccuguucuuuagaucuacaaugcccggauguuccggcuauccuaauauggaucuggacugccugcucccccaggaguggguccaacauuucuaccaggaagcugccccugcccagagcgauguggcucugcuucgguuugugaaccccgacaccgggcgcguucuguucgaguguaagcuccacaaaucuggauaugucacaguggcccauaccggccagcacgaucuggugaucccgccuaacggguacuuuagauucgacagcugggucaaucaauucuauacgcuugcucccaugggcaacggaaccggccggagacgcgcccuguga

SEQ ID NO: 26480 - RNA, 1623 nt, Artificial Sequence
  derived and/or modified sequence opt5 from capsid_protein_VP1__Norovirus__AFW15941
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucagaacgugcaccuugccccggcugucgcccccaccuuuccuggggagcagcuccuguucuuucggucuacaaugcccggauguuccggcuauccuaauauggaucuggacugccugcucccccaggagugggugcaacauuucuaccaggaagcggcuccugcccagagcgauguggcccugcuucgcuuuguuaaccccgacaccgggagaguccuguucgaguguaaacuccacaagucuggauaugugacaguggcucauaccggccagcacgaucuggucaucccgccuaacggguacuuucgguucgacagcugggugaaucaauucuauacgcuugcccccaugggcaacggaaccggcagacgccgggcucuguga

SEQ ID NO: 26481 - RNA, 1623 nt, Artificial Sequence
  derived and/or modified sequence opt5 from capsid_protein_VP1__Norovirus__AFW15944
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacugguccucuuaugaucccaccgaggaaaucccugcuccccugggcacaccggacuucgucgggaaaauucagggagugcuuacgcagaccacacggaccaauggcagcacacgcgggcacaaggcgaccguuuacacgggauccgccgacuuuagcccuaagcugggcagagugcaauucgcuacagauaccgacaacgauuuugagaccaaucagaacacaaaauucacccccgucggggugauccaggacggaucuacaacgccccggaaugaaccucaacaguggguucucccguccuacagcggccgcaacauucauaaugugcaccuggcccccgccgucgcuccuaccuuucccggcgagcagcuucuguucuuuagaucuacaaugccuggguguagcggauaucccaacauggaucucgacugccugcugccucaggaaugggugcaauacuucuaucaggaggccgcgcccgcucaguccgauguggcccuccugcgguuuguuaauccggacaccggcagaguccuuuucgaguguaagcugcacaaaucuggguacgugacaguggcccauaccggacagcacgaucucgucaucccucccaacggcuauuuucgcuucgacagcugggugaaccaauucuacacgcuggcuccuauggggaauggcaccggacggagacgcgcccuuuga

SEQ ID NO: 26482 - RNA, 1623 nt, Artificial Sequence
  derived and/or modified sequence opt5 from capsid_protein_VP1__Norovirus__AFW15947
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcgcccuuuga

SEQ ID NO: 26483 - RNA, 1623 nt, Artificial Sequence
  derived and/or modified sequence opt5 from capsid_protein_VP1__Norovirus__AFW15948
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccaacgccuucgugguucagccucagaauggacgguguacaaccgauggcgugcuccuggggacgacacaacugagccccgucaacauuugcaccuuucgcggagacgugacacauaucccuggcucuagaaauuacaccaugaaccucgccucccagaauuggaacagcuaugaucccaccgaggaaaucccugcuccccugggcacaccggacuucgucgggaaaauucagggagugcuuacgcagaccacacggaccaauggcuccacacgcgggcacaaggcgaccguuuacacgggaucugccgacuuuagcccuaagcugggcagagugcaauucgcuacagauaccgacaacgauuuugagaccaaucagaacacaaaauucacccccgucggggugauccaggacggauccacaacgccccggaaugaaccucaacaguggguucucccgagcuacucuggccgcaacauucauaaugugcaccuggcccccgccgucgcuccuaccuuucccggcgagcagcuucuguucuuuagauccacaaugccuggguguagcggauaucccaacauggaucucgacugccugcugccucaggaaugggugcaauacuucuaucaggaggccgcgcccgcucagucugauguggcccuccugcgguuuguuaacccggacaccggcagaguccuuuucgaguguaagcugcacaaaagcggguacgugacaguggcccauaccggacagcacgaucucgucaucccucccaauggcuauuuucgcuucgacuccugggugaaccaauucuacacgcuggcuccuauggggaauggcaccggacggagacgcgcccuuuga

SEQ ID NO: 26484 - RNA, 1623 nt, Artificial Sequence; identical to SEQ ID NO: 26482
  derived and/or modified sequence opt5 from capsid_protein_VP1__Norovirus__AFW15949

SEQ ID NO: 26485 - RNA, 1623 nt, Artificial Sequence
  derived and/or modified sequence opt5 from capsid_protein_VP1__Norovirus__AFW15950
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaaugucugcaccuuucgcggagacgugacacauaucuccggcagcagaaacuacaccaugaaucucgccucccagaacuggaccucuuaugauccuacagaggaaauccccgcuccucugggcacgcccgacuucgucgggaaaauucagggagugcuuacccagacaacccggacaaauggcagcacccgcgggcacaaggcgacgguuuacacaggauccgccgacuuuagcccgaagcugggcagagugcaauucgcuaccgauaccgacaacgauuuugagacaaaucagaacaccaaauucacaccugucggggugauccaggacggaucuacgacaccccggaaugaaccccaacaguggguucucccuuccuacagcggccgcaacauucauaaugugcaccuggccccggccgucgcucccaccuuuccuggcgagcagcuucuguucuuuagaucuaccaugcccggguguagcggauauccuaacauggaucucgacugccugcugccccaggaaugggugcaauacuucuaucaggaggccgcgccugcucaguccgauguggcccuccugcgguuuguuaaucccgacacaggcagaguccuuuucgaguguaagcugcacaaaucuggguacgugaccguggcccauacgggacagcacgaucucgucaucccgccuaacggcuauuuucgcuucgacagcugggugaaccaauucuacacccuggcucccauggggaauggcacaggacggagacgcgcccuuuga

SEQ ID NO: 26486 - RNA, 1623 nt, Artificial Sequence
  derived and/or modified sequence opt5 from capsid_protein_VP1__Norovirus__AFW15951
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucuccggcagcagaaacuacaccaugaaucucgccucccagaacuggaccucuuaugauccuacagaggaaauucccgcuccucugggcacgcccgacuucguggggaaaauccagggaguccuuacccagacaacccggacaaauggcagcacccgcgggcacaaggcgacgguguacacaggauccgccgacuuuagcccgaagcugggcagaguucaauucgcuaccgauaccgacaacgauuuugagacaaaucagaacaccaaauucacaccugugggggucauucaggacggaucuacgacaccccggaaugaaccccaacagugggugcucccuuccuacagcggccgcaacauccauaauguucaccuggccccggccguggcucccaccuuuccuggcgagcagcuucuguucuuuagaucuaccaugcccggguguagcggauauccuaacauggaucucgacugccugcugccccaggaauggguccaauacuucuaucaggaggccgcgccugcucaguccgauguggcccuccugcgguuugugaaucccgacacaggcagaguucuuuucgaguguaagcugcacaaaucuggguacgucaccguggcccauacgggacagcacgaucucgugauuccgccuaacggcuauuuucgcuucgacagcugggucaaccaauucuacacccuggcucccauggggaauggcacaggacggagacgcgcccuuuga

SEQ ID NO: 26487 - RNA, 1653 nt, Artificial Sequence
  derived and/or modified sequence opt5 from capsid_protein_VP1__Norovirus__AFX71665
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccgccaucgauaugcucuauacagacccuaaugaauccauugugguccaaccccagaacggcagaugcacccuggaugggacacuucagggaaccacgcagcuggugccgacacaaaucugugcuuuucggggcacccucauuagccagacagcgcgcgccgcugacucuaccgauuccccucagagagcccggaaucacccccugcauguucaagugaagaaccuugacgggacccaguacgauccuacagacgacauccccgccguccugggagcuaucgauuuccagggcacgguguucggcgucgccagccagcgcgacgugucugggcaacaggagcagggacacuaugcgaccagagcucacgaagcccauauugauacaaccgacccuaaauacgcccccaagcucggcacaauccugauuaaguccgauagcgacgauuuuaauaccaaccagccgauccgguucacgccuguugggaugggagacaauaacuggagacaaugggagcugcccgauuacuccggccgccucacacugaauaugaaccuugcucccgccgugucuccuagcuuuccgggggagcggauucuguucuuuagauccaucguccccagcgcuggaggcuauggcucuggguacaucgacugccucauuccucaggaaugggugcagcacuucuaucaggaggccgcgcccucccaaagcgccguugcucuggugcgcuacgucaauccugauaccggacggaacaucuuugaagccaaacuucauagagagggcuuccugaccguggcuaauucugggaacaaucccauugugguuccucccaacggauauuuucgcuucgaagccugggucaaccaguuuuacacacucgcgccgaugggcagcgggcagggccggagacgcgcccaguga

SEQ ID NO: 26488 - RNA, 1623 nt, Artificial Sequence
  derived and/or modified sequence opt5 from capsid_protein_VP1__Norovirus__AFX71668
augaagauggccagcuccgacgcuucucccagcgauggcuccaccgccaaccuggugccugaggucaauaacgaaguuauggcgcucgagccgguggcuggggccgccaucgcugcccccguggcuggacagcaaaaugucauugacccuuggaucagaaacaauuucgugcaggcccccggcggggaauuuacaguuucuccucggaacgcgcccggagagauucuguggagcgccccucuuggcccggaucugaaucccuaccucucccaccuggcucgcauguauaacggguacgccggaggcuucgaagugcaggucauccuugcuggcaaugccuuuacggcggggaaaauuaucuucgccgcugugccucccaacuuuccuaccgagggacugucucccagccagguuacaauguucccgcauaucauuguggacgucagacaacucgagccugugcugaucccccugccugaugugcggaauaacuuuuaucacuacaaucagcucaacgaccccaccauuaagcugaucgccaugcuuuauacaccccugcgcgcuaauaacgccggcgaugacgucuucaccguuuccugcagagugcucacacggccuagcccggauuuugacuucauuuuucuggugcccccuaccgucgaaucucgcacgaaacccuucuccgugccuguucuuaccguggaggaaaugacaaacagcagauuucccaucccgcuggagaagcuguucaccgggccuucuuccgccuucgucgugcagccccagaauggacgguguacaaccgauggcguucugcuggggacgacacaacucagcccugugaacauuugcaccuuucgcggagacgucacacauaucucuggcuccagaaauuacaccaugaaccuggcuagccagaauuggaacuccuaugaucccaccgaggaaaucccugcgccccuuggcacaccggacuucguggggaaaauucagggaguccugacgcagaccacacggaccaauggcucuacacgcgggcacaaggccaccguguacacgggaagcgcugacuuuuccccuaagcucggcagaguucaauucgccacagauaccgacaacgauuuugagaccaaucagaacacaaaauucacccccgugggggucauccaggacggaaauacaacgccccggaacgaaccucaacagugggugcugccgagcuacucuggccgcaauauucagaacguucaucuugcccccgcuguggccccuaccuuucccggcgagcagcuccucuucuuuagauccacaaugccuggguguagcggauaucccaauauggaucuggacugccugcucccucaagaauggguccaguacuucuaucaggaggcggcucccgcccagucugauguggcccugcuucgguuugugaacccggacaccggcagaguucuguucgaguguaagcuccacaaaagcggguacgucacaguggcucacaccggacaacaugaucuggugaucccucccaacggcuauuuucgcuucgacuccugggucaaucaguucuacacgcuugccccuauggggaacggcaccggacggagacgcgcucuguga

SEQ ID NO: 26489 - RNA, 1623 nt, Artificial Sequence; identical to SEQ ID NO: 26475
  derived and/or modified sequence opt5 from capsid_protein_VP1__Norovirus__AFX81121

SEQ ID NO: 26490 - RNA, 1623 nt, Artificial Sequence; identical to SEQ ID NO: 26475
  derived and/or modified sequence opt5 from capsid_protein_VP1__Norovirus__AFX81127

SEQ ID NO: 26491 - RNA, 1623 nt, Artificial Sequence; identical to SEQ ID NO: 26475
  derived and/or modified sequence opt5 from capsid_protein_VP1__Norovirus__AFX81130

SEQ ID NO: 26492 - RNA, 1623 nt, Artificial Sequence; identical to SEQ ID NO: 26475
  derived and/or modified sequence opt5 from capsid_protein_VP1__Norovirus__AFX81136

SEQ ID NO: 26493 - RNA, 1623 nt, Artificial Sequence; identical to SEQ ID NO: 26475
  derived and/or modified sequence opt5 from capsid_protein_VP1__Norovirus__AFX81139

SEQ ID NO: 26494 - RNA, 1623 nt, Artificial Sequence; identical to SEQ ID NO: 26475
  derived and/or modified sequence opt5 from capsid_protein_VP1__Norovirus__AFX81142

SEQ ID NO: 26495 - RNA, 1623 nt, Artificial Sequence; identical to SEQ ID NO: 26475
  derived and/or modified sequence opt5 from capsid_protein_VP1__Norovirus__AFX81145

SEQ ID NO: 26496 - RNA, 1623 nt, Artificial Sequence; identical to SEQ ID NO: 26475
  derived and/or modified sequence opt5 from capsid_protein_VP1__Norovirus__AFX81148

SEQ ID NO: 26497 - RNA, 1623 nt, Artificial Sequence; identical to SEQ ID NO: 26475
  derived and/or modified sequence opt5 from capsid_protein_VP1__Norovirus__AFX81154

SEQ ID NO: 26498 - RNA, 1623 nt, Artificial Sequence; identical to SEQ ID NO: 26475
  derived and/or modified sequence opt5 from capsid_protein_VP1__Norovirus__AFX81157

SEQ ID NO: 26499 - RNA, 1623 nt, Artificial Sequence; identical to SEQ ID NO: 26475
  derived and/or modified sequence opt5 from capsid_protein_VP1__Norovirus__AFX81163

SEQ ID NO: 26500 - RNA, 1623 nt, Artificial Sequence
  derived and/or modified sequence opt5 from capsid_protein_VP1__Norovirus__AFX81166
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgggcucuguga

SEQ ID NO: 26501 - RNA, 1623 nt, Artificial Sequence; identical to SEQ ID NO: 26475
  derived and/or modified sequence opt5 from capsid_protein_VP1__Norovirus__AFX81169

SEQ ID NO: 26502 - RNA, 1623 nt, Artificial Sequence; identical to SEQ ID NO: 26475
  derived and/or modified sequence opt5 from capsid_protein_VP1__Norovirus__AFX81172

SEQ ID NO: 26503 - RNA, 1623 nt, Artificial Sequence; identical to SEQ ID NO: 26475
  derived and/or modified sequence opt5 from capsid_protein_VP1__Norovirus__AFX81178

SEQ ID NO: 26504 - RNA, 1623 nt, Artificial Sequence; identical to SEQ ID NO: 26475
  derived and/or modified sequence opt5 from capsid_protein_VP1__Norovirus__AFX81181

SEQ ID NO: 26505 - RNA, 1623 nt, Artificial Sequence; identical to SEQ ID NO: 26475
  derived and/or modified sequence opt5 from capsid_protein_VP1__Norovirus__AFX81190

SEQ ID NO: 26506 - RNA, 1623 nt, Artificial Sequence; identical to SEQ ID NO: 26475
  derived and/or modified sequence opt5 from capsid_protein_VP1__Norovirus__AFX81193

SEQ ID NO: 26507 - RNA, 1623 nt, Artificial Sequence; identical to SEQ ID NO: 26475
  derived and/or modified sequence opt5 from capsid_protein_VP1__Norovirus__AFX81196

SEQ ID NO: 26508 - RNA, 1623 nt, Artificial Sequence
  derived and/or modified sequence opt5 from capsid_protein_VP1__Norovirus__AFX81199
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagagacuacaccaugaaccucgcgagccugaauuggaacaauuaugauccuacagaagagauucccgccccucuugggacgcccgacuucgugggaaaaauccagggcguccugacccagacaaccaagggggacggaucuacacggggccacaaggcuaccguguacacgggguccgccccguuuacaccuaaacucggaagcguucaguucuccaccgauaccgaaaacgacuuugagacacaucaaaauaccaaguucacacccgugggcgucauucaggauggcgggacgacccaccgcaacgaaccccagcaaugggugcugccuucuuacagcggaagagacguucacaaugugcaucuugccccggcugucgcccccacauuuccuggcgagcagcuccuguucuuucgguccaccaugcccggguguagcggauauccuaacauggaucuggacugccugcucccccaggagugggugcagcacuucuaccaagaagcggcuccugcccagucugauguggcccugcuucgcuuuguuaaucccgacacaggcagaguccuguucgaguguaaacuccauaaguccggguaugugaccguggcucacacgggccagcacgaucuggucaucccgccuaacggauacuuucgguucgacagcugggugaaucaguucuauacccuugcccccaugggcaacgggacaggaagacgccgggcucuguga

SEQ ID NO: 26509 - RNA, 1623 nt, Artificial Sequence; identical to SEQ ID NO: 26475
  derived and/or modified sequence opt5 from capsid_protein_VP1__Norovirus__AFX81202

SEQ ID NO: 26510 - RNA, 1623 nt, Artificial Sequence
  derived and/or modified sequence opt5 from capsid_protein_VP1__Norovirus__AFX81205
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggcccugccuucuuacagcggaagagaugugcacaacguucaucuugcuccggccguggcgcccacauuuccuggcgagcagcuccuguucuuucgguccaccaugcccggguguagcggauauccuaauauggaccuggauugccugcucccccaggaguggguccagcacuucuaccaagaagcugccccugcccagucugacguggcucugcuucgcuuugugaaccccgauacaggcagaguucuguucgaguguaaacuccauaaguccggguaugucaccguggcccacacgggccagcacgaccuggugaucccgccuaauggauacuuucgguucgauagcugggucaaccaguucuauacccuugcucccaugggcaacgggacaggaagacgccgggcccuguga

SEQ ID NO: 26511 - RNA, 1623 nt, Artificial Sequence; identical to SEQ ID NO: 26475
  derived and/or modified sequence opt5 from capsid_protein_VP1__Norovirus__AFX81208

SEQ ID NO: 26512 - RNA, 1623 nt, Artificial Sequence; identical to SEQ ID NO: 26475
  derived and/or modified sequence opt5 from capsid_protein_VP1__Norovirus__AFX81211

SEQ ID NO: 26513 - RNA, 1623 nt, Artificial Sequence; identical to SEQ ID NO: 26475
  derived and/or modified sequence opt5 from capsid_protein_VP1__Norovirus__AFX81214

SEQ ID NO: 26514 - RNA, 1623 nt, Artificial Sequence; identical to SEQ ID NO: 26475
  derived and/or modified sequence opt5 from capsid_protein_VP1__Norovirus__AFX81226

SEQ ID NO: 26515 - RNA, 1623 nt, Artificial Sequence
  derived and/or modified sequence opt5 from capsid_protein_VP1__Norovirus__AFX81229
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugagccucgcgucucugaauuggaacaauuaugacccuacagaagagauucccgccccucuugggacgcccgauuucgugggaaaaauccagggcguccugacccagacaaccaagggggacggauccacacggggccacaaggcuaccguguacacggggagcgccccguuuacaccuaaacucggauccguucaguucucuaccgacaccgaaaacgauuuugagacacaucaaaauaccaaguucacacccgugggcgucauucaggacggcgggacgacccaccgcaacgaaccccagcaaugggugcugccuagcuacuccggaagagauguucacaaugugcaucuugccccggcugucgcccccacauuuccuggcgagcagcuccuguucuuucggagcaccaugcccggguguucuggauauccuaacauggaccuggauugccugcucccccaggagugggugcagcacuucuaccaagaagcggcuccugcccaguccgacguggcccugcuucgcuuuguuaaucccgauacaggcagaguccuguucgaguguaaacuccauaagagcggguaugugaccguggcucacacgggccagcacgaccuggucaucccgccuaacggauacuuucgguucgauucuugggugaaucaguucuauacccuugcccccaugggcaacgggacaggaagacgccgggcucuguga

SEQ ID NO: 26516 - RNA, 1623 nt, Artificial Sequence; identical to SEQ ID NO: 26475
  derived and/or modified sequence opt5 from capsid_protein_VP1__Norovirus__AFX81232

SEQ ID NO: 26517 - RNA, 1623 nt, Artificial Sequence; identical to SEQ ID NO: 26475
  derived and/or modified sequence opt5 from capsid_protein_VP1__Norovirus__AFX81238

SEQ ID NO: 26518 - RNA, 1623 nt, Artificial Sequence
  derived and/or modified sequence opt5 from capsid_protein_VP1__Norovirus__AFX81241
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcgcccuuuga

SEQ ID NO: 26519 - RNA, 1623 nt, Artificial Sequence
  derived and/or modified sequence opt5 from capsid_protein_VP1__Norovirus__AFX81247
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacugggauagcuaugacccuaccgaggaaacacccgcuccgcugggcacgccugacuucgucgggaaaauccagggagugcuuacccagacaacccggacaaauggcuccacccgcgggcacaaggcgacgguuuacacaggaucugccgauuuuagccccaagcugggcagagugcaauucgcuaccgacaccgauaacgacuuugagacaaaucagaacaccaaauucacacccgucggggugauucaggauggauccacgaccccucggaaugaaccgcaacaguggguucuccccagcuacucuggccgcaacauccauaaugugcaccuggccccugccgucgcucccacauuuccuggcgagcagcuucuguucuuuagauccaccaugcccggguguagcggauauccuaacauggaccucgauugccugcugccccaggaaugggugcaauacuucuaucaggaggccgcgccggcucagucugacguggcccuccugcgguuuguuaauccugauacaggcagaguccuuuucgaguguaagcugcacaaaagcggguacgugaccguggcccauacgggacagcacgaccucgucauucccccuaacggcuauuuucgcuucgauuccugggugaaccaauucuacacccuggcucccauggggaauggcacaggacggagacgcgcccuuuga

SEQ ID NO: 26520 - RNA, 1623 nt, Artificial Sequence
  derived and/or modified sequence opt5 from capsid_protein_VP1__Norovirus__AFX81250
augaagauggccagcuccgacgcuaaccccucuaauggcagcaccgccaaccuggugccugaggucaauaacgaaguuauggcgcucgagccgguggugggggcugccaucgccgcucccgucgccggacagcaaaaugugaucgauccuuggaucagaaacaauuucguucaggcucccggcggggaauuuacaguguccccucggaacgcccccggagagauucuguggucugcgccucuuggcccggaccugaaucccuaccucagccaccuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcauaucauugucgaugugagacaacucgagccugugcugaucccccugccugacguccggaauaacuuuuaucacuacaaucagagcaacgaucccaccauuaagcucaucgcuaugcuguauacaccccuucgcgccaacaaugcuggcgacgauguuuucaccguguccugcagagugcugacacggccuagcccggacuuugauuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgacggcgugcuccuggggacgacacaacugagcccugucaacauuugcaccuuucgcggagaugugacacauauccccucuucccacaauuacaccaugaaccucgccagccagaauuggaacuccuaugacccuaccgaggaaauccccgcuccgcugggcacaccugauuucgucggcaaaauucagggggugcuuacgcagaccacaagaaccgacggaucuacacggggccauaaggcgaccguuuacacggggagcgccgacuuuucccccaagcugggacgcgugcaauucgcuacagauaccgacaaugauuuucagaccaaccagaauacaaaauucacccccgucggcgugauccaagacgggagcacaacgccuagaaacgagccgcagcaguggguucuccccucuuacuccggacggaauauucacaacgugcaccuggccccugccgucgcucccaccuuuccuggcgaacagcuucuguucuuucgcagcacaaugcccggcuguucuggguauccuaauauggaucucgacugccugcugccccaagagugggugcaguacuucuaucaggaagccgcgccggcucagagcgauguggcccuccugagauuuguuaacccugacaccggacggguccuuuucgaguguaagcugcauaaauccggcuacgugacaguggcccacaccgggcaacaugaucucgucauucccccuaacggauauuuuagauucgacucuugggugaaucaguucuacacgcuggcucccaugggcaacgggaccggccgccggagagcccuuuga

SEQ ID NO: 26521 - RNA, 1623 nt, Artificial Sequence; identical to SEQ ID NO: 26518
  derived and/or modified sequence opt5 from capsid_protein_VP1__Norovirus__AFX81253

SEQ ID NO: 26522 - RNA, 1623 nt, Artificial Sequence
  derived and/or modified sequence opt5 from capsid_protein_VP1__Norovirus__AFX81256
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacagcacgaucucgucauucccccuaacggcuauuuucgcuucgacuccugggugaaucaauucuacacgcuggcucccauggggaacggcaccggacggagacgcgcccuuuga

SEQ ID NO: 26523 - RNA, 1623 nt, Artificial Sequence; identical to SEQ ID NO: 26475
  derived and/or modified sequence opt5 from capsid_protein_VP1__Norovirus__AFX81262

SEQ ID NO: 26524 - RNA, 1623 nt, Artificial Sequence; identical to SEQ ID NO: 26475
  derived and/or modified sequence opt5 from capsid_protein_VP1__Norovirus__AFX81265

SEQ ID NO: 26525 - RNA, 1623 nt, Artificial Sequence
  derived and/or modified sequence opt5 from capsid_protein_VP1__Norovirus__AFX81268
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcggagccuucgucgugcagccucagaacggccgcuguaccacggacgggguucuccugggaacaacccagcugucucccgugaauaucugcacauuuagaggcgaugucacccauaucgcuggcucccggaacuacaccaugaaucucgcgagccugaacuggaauaacuaugacccuacagaagagauucccgccccucuugggacgcccgauuucgugggaaaaauccaaggcguccugacccagacaaccaagggggacggaucuacacgcggccacaaggcuaccguguacacgggguccgccccguuuacaccuaaacucggaagcguucaguucuccaccgacaccgaaaaugauuuugagacacaucagaacaccaaguucacacccgugggcgucauucaagacggcgggacgacccacagaaaugaaccccagcagugggugcugccuucuuacagcggacgggauguucacaacgugcaucuugccccggcugucgcccccacauuuccuggcgagcaacuccuguucuuucgcuccaccaugcccggguguagcggauauccuaauauggaccuggauugccugcucccccaggagugggugcagcacuucuaccaggaagcggcuccugcccaaucugacguggcccugcuuagauuuguuaaccccgauacaggccggguccuguucgaguguaaacuccauaaguccggguaugugaccguggcucacacgggccagcacgaccuggucaucccgccuaauggauacuuuagauucgauagcugggugaaccaguucuauacccuugcccccaugggcaacgggacaggacgccggagagcucuguga

SEQ ID NO: 26526 - RNA, 1623 nt, Artificial Sequence; identical to SEQ ID NO: 26475
  derived and/or modified sequence opt5 from capsid_protein_VP1__Norovirus__AFX81271

SEQ ID NO: 26527 - RNA, 1623 nt, Artificial Sequence
  derived and/or modified sequence opt5 from capsid_protein_VP1__Norovirus__AFX81274
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcggagccuucgucgugcagccucagaacggccgcuguaccacggacgggguucuccugggaacaacccagcugucucccguguccaucugcacauuuagaggcgaugucacccauaucgcuggcagccggaauuacaccaugaaccucgcgucucugaauuggaacaauuaugacccuacagaagagauucccgccccucuugggacgcccgauuucgugggaaaaauccaaggcguccugacccagacaaccaagggggacggauccacacgcggccacaaggcuaccguguacacggggagcgccccguuuacaccuaaacucggauccguucaguucucuaccgacaccgaaaacgauuuugagacacaucagaauaccaaguucacacccgugggcgucauucaagacggcgggacgacccacagaaacgaaccccagcagugggugcugccuagcuacuccggacgggauguucacaaugugcaucuugccccggcugucgcccccacauuuccuggcgagcaacuccuguucuuucgcagcaccaugcccggguguucuggauauccuaacauggaccuggauugccugcucccccaggagugggugcagcacuucuaccaggaagcggcuccugcccaauccgacguggcccugcuuagauuuguuaaucccgauacaggccggguccuguucgaguguaaacuccauaagagcggguaugugaccguggcucacacgggccagcacgaccuggucaucccgccuaacggauacuuuagauucgauucuugggugaaucaguucuauacccuugcccccaugggcaacgggacaggacgccggagagcucuguga

SEQ ID NO: 26528 - RNA, 1623 nt, Artificial Sequence; identical to SEQ ID NO: 26525
  derived and/or modified sequence opt5 from capsid_protein_VP1__Norovirus__AFX81277

SEQ ID NO: 26529 - RNA, 1623 nt, Artificial Sequence
  derived and/or modified sequence opt5 from capsid_protein_VP1__Norovirus__AFX81283
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcucuacgacccaccgcaaugaaccccagcaaugggugcugccuagcuacuccgggagagauguucacaacgugcaucuugccccggcugucgcccccacauuuccuggagagcagcuccuguucuuucggagcaccaugcccggcuguucuggguauccuaauauggaccuggauugccugcucccccaggagugggugcagcacuucuaccaagaagcggcuccugcccaguccgacguggcccugcuucgcuuuguuaaccccgauacaggaagaguccuguucgaguguaaacuccauaagagcggcuaugugaccguggcucacacggggcagcacgaccuggucaucccgccuaauggcuacuuucgguucgauucuugggugaaccaguucuauacccuugcccccaugggaaacggcacagggagacgccgggcucuguga

SEQ ID NO: 26530 - RNA, 1623 nt, Artificial Sequence; identical to SEQ ID NO: 26475
  derived and/or modified sequence opt5 from capsid_protein_VP1__Norovirus__AFX81289

SEQ ID NO: 26531 - RNA, 1623 nt, Artificial Sequence; identical to SEQ ID NO: 26475
  derived and/or modified sequence opt5 from capsid_protein_VP1__Norovirus__AFX81292

SEQ ID NO: 26532 - RNA, 1623 nt, Artificial Sequence; identical to SEQ ID NO: 26475
  derived and/or modified sequence opt5 from capsid_protein_VP1__Norovirus__AFX81295

SEQ ID NO: 26533 - RNA, 1623 nt, Artificial Sequence; identical to SEQ ID NO: 26475
  derived and/or modified sequence opt5 from capsid_protein_VP1__Norovirus__AFX81298

SEQ ID NO: 26534 - RNA, 1623 nt, Artificial Sequence
  derived and/or modified sequence opt5 from capsid_protein_VP1__Norovirus__AFX81301
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcuccacaacgcaccgcaaugaaccccagcaaugggugcugccuagcuacucuggcagaaacguuccgaaugugcaccuugcccccgcugucgccccuaccuuucccggggagcagcuccuguucuuucgguccacaaugccuggauguagcggcuaucccaacauggaucuggacugccugcucccucaggagugggugcagcauuucuaccaagaagcggcucccgcccagucugauguggcccugcuucgcuuuguuaauccggacaccgggagaguccuguucgaguguaaacuccacaagagcggauaugugacaguggcucauaccggccagcacgaucuggucaucccucccaacggguacuuucgguucgacuccugggugaaccaguucuauacgcuugccccuaugggcaauggaaccggcagacgccgggcucuguga

SEQ ID NO: 26535 - RNA, 1623 nt, Artificial Sequence; identical to SEQ ID NO: 26475
  derived and/or modified sequence opt5 from capsid_protein_VP1__Norovirus__AFX81304

SEQ ID NO: 26536 - RNA, 1623 nt, Artificial Sequence; identical to SEQ ID NO: 26475
  derived and/or modified sequence opt5 from capsid_protein_VP1__Norovirus__AFX81307

SEQ ID NO: 26537 - RNA, 1623 nt, Artificial Sequence; identical to SEQ ID NO: 26475
  derived and/or modified sequence opt5 from capsid_protein_VP1__Norovirus__AFX81313

SEQ ID NO: 26538 - RNA, 1623 nt, Artificial Sequence; identical to SEQ ID NO: 26475
  derived and/or modified sequence opt5 from capsid_protein_VP1__Norovirus__AFX81316

SEQ ID NO: 26539 - RNA, 1623 nt, Artificial Sequence; identical to SEQ ID NO: 26475
  derived and/or modified sequence opt5 from capsid_protein_VP1__Norovirus__AFX81319

SEQ ID NO: 26540 - RNA, 1623 nt, Artificial Sequence; identical to SEQ ID NO: 26475
  derived and/or modified sequence opt5 from capsid_protein_VP1__Norovirus__AFX81322

SEQ ID NO: 26541 - RNA, 1623 nt, Artificial Sequence; identical to SEQ ID NO: 26475
  derived and/or modified sequence opt5 from capsid_protein_VP1__Norovirus__AFX81325

SEQ ID NO: 26542 - RNA, 1623 nt, Artificial Sequence; identical to SEQ ID NO: 26475
  derived and/or modified sequence opt5 from capsid_protein_VP1__Norovirus__AGE89433

SEQ ID NO: 26543 - RNA, 1623 nt, Artificial Sequence; identical to SEQ ID NO: 26475
  derived and/or modified sequence opt5 from capsid_protein_VP1__Norovirus__AGE89436

SEQ ID NO: 26544 - RNA, 1623 nt, Artificial Sequence; identical to SEQ ID NO: 26522
  derived and/or modified sequence opt5 from capsid_protein_VP1__Norovirus__AGE89439

SEQ ID NO: 26545 - RNA, 1623 nt, Artificial Sequence
  derived and/or modified sequence opt5 from capsid_protein_VP1__Norovirus__AGE89442
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauauccccggcuccagaaauuacaccaugaaccucgccagccagaauuggaacuccuaugauccuaccgaggaaauccccgcuccgcugggcacaccugacuucgucgggaaaauucagggagugcuuacgcagaccacacggaccgacggcucuacacgcgggcacaaggcgaccguuuacacgggaagcgccgauuuuucccccaagcugggcagagugcaauucgcuacagacaccgauaaugacuuugagaccaaccagaauacaaaauucacccccgucggggugauccaggauggaagcacaacgcaucggaacgaaccucaacaguggguucucccgucuuacuccggccgcgacgugcacaauguccaccuggcccccgccguggcuccuaccuuucccggcgagcagcuucuguucuuuagaagcacaaugccuggguguucuggauaucccaacauggaucucgacugccugcugccucaggaaugggugcaauacuucuaucaggaggccgcgcccgcucagagcgauguugcccuccugcgguuugucaauccggacaccggcagagugcuuuucgaguguaagcugcauaaauccggguacgugacagucgcccacaccggacagcaugaucucgugauuccucccaacggcuauuuucgcuucgacucuuggguuaaucaauucuacacgcuggcuccuauggggaacggcaccggacggagacgcgcccuuuga

SEQ ID NO: 26546 - RNA, 1623 nt, Artificial Sequence
  derived and/or modified sequence opt5 from capsid_protein_VP1__Norovirus__AGE89445
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauauccccggcuccagaaauuacaccaugaaccucgccagccagaauuggaacuccuaugauccuaccgaggaaauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaacgauuuugagaccaaucagaacacaaaauucacccccgucggggugauccaggacggaagcacaacgccucggaaugaaccgcaacaguggguucuccccucuuacuccggccgcaacauucauaaugugcaccuggccccugccgucgcucccaccuuuccuggcgagcagcuucuguucuuuagaagcacaaugcccggguguucuggauauccuaacauggaucucgacugccugcugccccaggaaugggugcaauacuucuaucaggaggccgcgccggcucagagcgauguggcccuccugcgguuuguuaauccugacaccggcagaguccuuuucgaguguaagcugcacaaauccggguacgugacaguggcccauaccggacagcacgaucucgucauucccccuaacggcuauuuucgcuucgacucuugggugaaccaauucuacacgcuggcucccauggggaauggcaccggacggagacgcgcccuuuga

SEQ ID NO: 26547 - RNA, 1623 nt, Artificial Sequence; identical to SEQ ID NO: 26522
  derived and/or modified sequence opt5 from capsid_protein_VP1__Norovirus__AGE89448

SEQ ID NO: 26548 - RNA, 1623 nt, Artificial Sequence; identical to SEQ ID NO: 26475
  derived and/or modified sequence opt5 from capsid_protein_VP1__Norovirus__AGE89451

SEQ ID NO: 26549 - RNA, 1623 nt, Artificial Sequence
  derived and/or modified sequence opt5 from capsid_protein_VP1__Norovirus__AGE89454
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggggcgccccucuugggccggaucugaaccccuaccucucucaccuggcucgcauguauaauggauacgccggcggcuucgaaguccaggugauccuugcugggaacgccuuuacagcgggaaaaauuaucuucgccgcuguuccucccaauuuuccuacggagggccugagccccucccaggugaccauguucccgcauaucauugucgacgugagacaacucgagccugugcugaucccccugccugauguccggaacaauuuuuaucacuacaaccagacaaaugacucuaccauuaagcucaucgccaugcuguauacaccccuucgcgcuaacaacgccggggaagauguuuucaccgugagcugcagagugcugacacggcccuccccugacuuugauuucauuuuucucgucccgcccaccguggagagccgcacgaaaccuuucaccguucccauccugacaguggaagagaugaccaauucuagauuuccuauuccccuugagaagcuguucacaggaccguccggcgccuucgucgugcagccucagaacgggcgguguaccacggacggaguucuccugggcacaacccaacugagccccgugaauaucugcacauuucgcggcgaugucacccauaucgcugggucuagaaacuacaccaugaaucucgcgucccugaacuggaauaacuaugacccuacagaagagauucccgccccucuuggaacgcccgauuucgugggcaaaauccaggggguccugacccagacaaccaagggagacggcagcacacgggggcacaaggcuaccguguacacgggaucugccccguuuacaccuaaacucggcuccguucaguucagcaccgacaccgaaaaugauuuugagacacaucaaaacaccaaguucacacccgugggcgucauucaggacgggggaacgacccaccgcaaugaaccccagcaaugggugcugccuuccuacucuggcagagauguucacaacgugcaucuugccccggcugucgcccccacauuuccuggggagcagcuccuguucuuucggagcaccaugcccggauguuccggcuauccuaauauggaccuggauugccugcucccccaggagugggugcagcacuucuaccaagaagcggcuccugcccagagcgacguggcccugcuucgcuuuguuaaccccgauacagggagaguccuguucgaguguaaacuccauaagucuggcuaugugaccguggcucacaauggacagcacgaccuggucaucccgccuaacggcuacuuucgguucgauuccugggugaaccaguucuauacgcuugcccccauggggaauggaaccggcagacgccgggcucuguga

SEQ ID NO: 26550 - RNA, 1623 nt, Artificial Sequence; identical to SEQ ID NO: 26475
  derived and/or modified sequence opt5 from capsid_protein_VP1__Norovirus__AGE89457

SEQ ID NO: 26551 - RNA, 1623 nt, Artificial Sequence; identical to SEQ ID NO: 26475
  derived and/or modified sequence opt5 from capsid_protein_VP1__Norovirus__AGE89460

SEQ ID NO: 26552 - RNA, 1623 nt, Artificial Sequence; identical to SEQ ID NO: 26475
  derived and/or modified sequence opt5 from capsid_protein_VP1__Norovirus__AGE89463

SEQ ID NO: 26553 - RNA, 1623 nt, Artificial Sequence; identical to SEQ ID NO: 26475
  derived and/or modified sequence opt5 from capsid_protein_VP1__Norovirus__AGE89466

SEQ ID NO: 26554 - RNA, 1623 nt, Artificial Sequence; identical to SEQ ID NO: 26549
  derived and/or modified sequence opt5 from capsid_protein_VP1__Norovirus__AGE89472

SEQ ID NO: 26555 - RNA, 1623 nt, Artificial Sequence; identical to SEQ ID NO: 26525
  derived and/or modified sequence opt5 from capsid_protein_VP1__Norovirus__AGE89475

SEQ ID NO: 26556 - RNA, 1623 nt, Artificial Sequence; identical to SEQ ID NO: 26475
  derived and/or modified sequence opt5 from capsid_protein_VP1__Norovirus__AGE89478

SEQ ID NO: 26557 - RNA, 1623 nt, Artificial Sequence
  derived and/or modified sequence opt5 from capsid_protein_VP1__Norovirus__AGE89481
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaaggaagacgggucuacacggggacacaaggcuaccguguacacgggcuccgccccguuuacaccuaaacucgggagcguucaguucuccaccgacaccgagaaugauuuugaaacacaucaaaacaccaaguucacacccgugggagucauucaggacggcggcacgacccaccgcaaugagccccagcaaugggugcugccuucuuacagcgggagagauguucacaacgugcaucuugccccggcugucgcccccacauuuccuggagagcagcuccuguucuuucgguccaccaugcccggcuguagcggguauccuaauauggaccuggauugccugcucccccaggaaugggugcagcacuucuaccaagaggcggcuccugcccagucugacguggcccugcuucgcuuuguuaaccccgauacaggaagaguccuguucgaauguaaacuccauaaguccggcuaugugaccguggcucacacggggcagcacgaccuggucaucccgccuaauggcuacuuucgguucgauagcugggugaaccaguucuauacccuugcccccaugggaaacggcacagggagacgccgggcucuguga

SEQ ID NO: 26558 - RNA, 1623 nt, Artificial Sequence; identical to SEQ ID NO: 26475
  derived and/or modified sequence opt5 from capsid_protein_VP1__Norovirus__AGE89490

SEQ ID NO: 26559 - RNA, 1623 nt, Artificial Sequence; identical to SEQ ID NO: 26475
  derived and/or modified sequence opt5 from capsid_protein_VP1__Norovirus__AGE89493

SEQ ID NO: 26560 - RNA, 1623 nt, Artificial Sequence
  derived and/or modified sequence opt5 from capsid_protein_VP1__Norovirus__AGE89496
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguggcccugcuucgcuuuguuaaccccgauacaggcagaguccuguucgaguguaaacuccauaagccgggguaugugaccguggcucacacgggccagcacgaccuggucaucccucccaauggauacuuucgguucgauuccugggugaaccaguucuauacccuugccccuaugggcaacgggacaggaagacgccgggcucuguga

SEQ ID NO: 26561 - RNA, 1623 nt, Artificial Sequence; identical to SEQ ID NO: 26475
  derived and/or modified sequence opt5 from capsid_protein_VP1__Norovirus__AGE89499

SEQ ID NO: 26562 - RNA, 1623 nt, Artificial Sequence
  derived and/or modified sequence opt5 from capsid_protein_VP1__Norovirus__AGE89502
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcgcuuuucgcggcgaugucacacauaucgcgggcuccagaaacuacaccaugaaucucgccagccugaacuggaauaacuaugacccuaccgaagagauucccgcuccucuugggacacccgauuucgugggaaaaauccagggcguccugacgcagaccacaaagggggacggaucuacccggggccacaaggccacaguguacaccggguccgccccguuuacgccuaaacucggaagcguucaguucuccacagacaccgaaaaugauuuugagacccaucaaaacacaaaguucacccccgugggcgucauucaggacggcgggacaacgcaccgcaaugaaccccagcaaugggugcugccuucuuacagcggaagagauguucacaacgugcaucuugcuccggccgucgcgcccaccuuuccuggcgagcagcuccuguucuuucgguccacaaugcccggguguagcggauauccuaauauggaccuggauugccugcucccccaggagugggugcagcacuucuaccaagaagcugccccugcccagucugacguggcucugcuucgcuuuguuaaccccgauaccggcagaguccuguucgaguguaaacuccauaaguccggguaugugacaguggcccacaccggccagcacgaccuggucaucccgccuaauggauacuuucgguucgauagcugggugaaccaguucuauacgcuugcucccaugggcaacgggaccggaagacgccgggcccuguga

SEQ ID NO: 26563 - RNA, 1623 nt, Artificial Sequence; identical to SEQ ID NO: 26475
  derived and/or modified sequence opt5 from capsid_protein_VP1__Norovirus__AGE89505

SEQ ID NO: 26564 - RNA, 1623 nt, Artificial Sequence
  derived and/or modified sequence opt5 from capsid_protein_VP1__Norovirus__AGE89508
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccgccccguuuacgccuaaacucggaagcguucaguucuccacagauaccgaaaaugacuuugaggcccaucaaaacaccaaguucacacccgugggcgucauucaggauggcgggaccacacaccgcaaugaaccccagcaaugggugcugccuucuuacagcggaagagacguucacaacgugcaucuugcuccggccgucgcgcccacguuuccuggcgagcagcuccuguucuuucgguccaccaugcccggguguagcggauauccuaauauggaucuggacugccugcucccccaggagugggugcagcacuucuaccaagaagcugccccugcccagucugauguggcucugcuucgcuuuguuaaccccgacacaggcagaguccuguucgaguguaaacuccauaaguccggguaugugaccguggcccacacaggccagcacgaucuggucaucccgccuaauggauacuuucgguucgacagcugggugaaccaguucuauacccuugcucccaugggcaacgggacgggaagacgccgggcccuguga

SEQ ID NO: 26565 - RNA, 1623 nt, Artificial Sequence; identical to SEQ ID NO: 26475
  derived and/or modified sequence opt5 from capsid_protein_VP1__Norovirus__AGE89511

SEQ ID NO: 26566 - RNA, 1623 nt, Artificial Sequence; identical to SEQ ID NO: 26475
  derived and/or modified sequence opt5 from capsid_protein_VP1__Norovirus__AGE89514

SEQ ID NO: 26567 - RNA, 1623 nt, Artificial Sequence; identical to SEQ ID NO: 26475
  derived and/or modified sequence opt5 from capsid_protein_VP1__Norovirus__AGE89517

SEQ ID NO: 26568 - RNA, 1623 nt, Artificial Sequence; identical to SEQ ID NO: 26562
  derived and/or modified sequence opt5 from capsid_protein_VP1__Norovirus__AGE89520

SEQ ID NO: 26569 - RNA, 1623 nt, Artificial Sequence; identical to SEQ ID NO: 26475
  derived and/or modified sequence opt5 from capsid_protein_VP1__Norovirus__AGE89523

SEQ ID NO: 26570 - RNA, 1623 nt, Artificial Sequence; identical to SEQ ID NO: 26475
  derived and/or modified sequence opt5 from capsid_protein_VP1__Norovirus__AGE89526

SEQ ID NO: 26571 - RNA, 1623 nt, Artificial Sequence; identical to SEQ ID NO: 26557
  derived and/or modified sequence opt5 from capsid_protein_VP1__Norovirus__AGE89529

SEQ ID NO: 26572 - RNA, 1623 nt, Artificial Sequence; identical to SEQ ID NO: 26475
  derived and/or modified sequence opt5 from capsid_protein_VP1__Norovirus__AGE89532

SEQ ID NO: 26573 - RNA, 1623 nt, Artificial Sequence; identical to SEQ ID NO: 26525
  derived and/or modified sequence opt5 from capsid_protein_VP1__Norovirus__AGE89535

SEQ ID NO: 26574 - RNA, 1623 nt, Artificial Sequence
  derived and/or modified sequence opt5 from capsid_protein_VP1__Norovirus__AGE89538
augaagauggccagcaacgacgcuaaucccuccgauggcucugccgcgagccuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucagacaaacgacuccaccauuaagcucaucgccaugcuguauacaccccuucgcgcuaauaacgccggcgaagauguuuucaccgugagcugcagagugcugacacggcccucuccugacuuugauuucauuuuucucgucccgcccaccguggagucccgcacgaaaccuuucaccguucccauccugacaguggaagagaugaccaacagcagauuuccuauuccccuugagaagcuguucacagggccgucuggagccuucgucgugcagccucagaauggccgguguaccacggacgggguucuccugggaacaacccaacugucccccgugaacaucugcacauuucgcggcgaugucacccauaucgcuggcagcagaaauuacaccaugaaccucgcgucucugaauuggaacaauuaugacccuacagaagagauucccgccccucuugggacgcccgauuucgugggaaaaauccagggcguccugacccagacaaccaagggggacggauccacacggggccacaaggcuaccguguacacggggagcgccccguuuacaccuaaacucggauccguucaguucucuaccgacaccgaaaacgauuuugagacacaucaaaauaccaaguucacacccgugggcgucauucaggacggcgggacgacccaccgcaacgaaccccagcaaugggugcugccuagcuacuccggaagagauguucacaaugugcaucuugccccggcugucgcccccacauuuccuggcgagcagcuccuguucuuucggagcaccaugcccggguguucuggauauccuaacauggaccuggauugccugcucccccaggagugggugcagcacuucuaccaagaagcggcuccugcccaguccgacgccgcucugcuucgcuuugugaaucccgauacaggcagaguucuguucgaguguaaacuccauaagagcggguaugucaccguggcccacacgggccagcacgaccuggugaucccgccuaacggauacuuucgguucgauucuugggucaaucaguucuauacccuugcucccaugggcaacgggacaggaagacgccgggcccuguga

SEQ ID NO: 26575 - RNA, 1623 nt, Artificial Sequence; identical to SEQ ID NO: 26475
  derived and/or modified sequence opt5 from capsid_protein_VP1__Norovirus__AGE89541

SEQ ID NO: 26576 - RNA, 1623 nt, Artificial Sequence; identical to SEQ ID NO: 26475
  derived and/or modified sequence opt5 from capsid_protein_VP1__Norovirus__AGE89544

SEQ ID NO: 26577 - RNA, 1623 nt, Artificial Sequence; identical to SEQ ID NO: 26529
  derived and/or modified sequence opt5 from capsid_protein_VP1__Norovirus__AGE89547

SEQ ID NO: 26578 - RNA, 1623 nt, Artificial Sequence; identical to SEQ ID NO: 26508
  derived and/or modified sequence opt5 from capsid_protein_VP1__Norovirus__AGE89550

SEQ ID NO: 26579 - RNA, 1623 nt, Artificial Sequence
  derived and/or modified sequence opt5 from capsid_protein_VP1__Norovirus__AGE89553
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugaggcccaucaaaauaccaaguucacacccgugggcgucauucaggacggcgggaccacacaccgcaacgaaccccagcaaugggugcugccuucuuacagcggaagagauguucacaaugugcaucuugcuccggccgucgcgcccacguuuccuggcgagcagcuccuguucuuucgguccaccaugcccggguguagcggauauccuaacauggaccuggauugccugcucccccaggagugggugcagcacuucuaccaagaagcugccccugcccagucugacguggcucugcuucgcuuuguuaaucccgauacaggcagaguccuguucgaguguaaacuccauaaguccggguaugugaccguggcccacacaggccagcacgaccuggucaucccgccuaacggauacuuucgguucgauagcugggugaaccaguucuauacccuugcucccaugggcaaugggacgggaagacgccgggcccuguga

SEQ ID NO: 26580 - RNA, 1623 nt, Artificial Sequence; identical to SEQ ID NO: 26557
  derived and/or modified sequence opt5 from capsid_protein_VP1__Norovirus__AGE89556

SEQ ID NO: 26581 - RNA, 1623 nt, Artificial Sequence
  derived and/or modified sequence opt5 from capsid_protein_VP1__Norovirus__AGE89559
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaaggaagacgggucuacacggggacacaaggcuaccguguacacgggcuccgccccguuuacaccuaaacucgggagcguucaguucuccaccgacaccgagaaugauuuugaaacacaucaaaacaccaaguucacacccgugggagucauucaggacggcggcacgacccaccgcaaugagccccagcaaugggugcugccuucuuacagcgggagagauguucacaacgugcaucuugccccggcugucgcccccacauuuccuggagagcagauccuguucuuucgguccaccaugcccggcuguagcggguauccuaauauggaccucgauugccugcugccccaggaaugggugcagcacuucuaccaagaggcggcuccugcccagucugacguggcccuccugcgcuuuguuaaccccgauacaggaagaguccuuuucgaauguaaacugcauaaguccggcuaugugaccguggcucacacggggcagcacgaccucgucauuccgccuaauggcuacuuucgguucgauagcugggugaaccaguucuauacccuggcccccaugggaaacggcacagggagacgccgggcucuuuga

SEQ ID NO: 26582 - RNA, 1623 nt, Artificial Sequence
  derived and/or modified sequence opt5 from capsid_protein_VP1__Norovirus__AGE89562
augaagauggccagcaacgacgcuaaucccuccgauggcucugccgcgagccuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucagacaaacgaccccaccauuaagcucaucgccaugcuguauacaccccuucgcgcuaauaacgccggcgaagauguuuucaccguguccugcagagugcugacacggccuagcccggacuuugauuucauuuuucucgugcccccuaccgucgagucucgcacgaaacccuucaccguuccuauccugacaguggaagagaugaccaacuccagauuucccauuccgcuugagaagcuguucacagggccuagcggagccuucgucgugcagccccagaauggccgguguaccacggacgggguucuccugggaacaacccaacugucuccugugaacaucugcacauuucgcggcgaugucacccauaucgcuggcuccagaaauuacaccaugaaccucgcgagccugaauuggaacaauuaugaccccacagaagagauuccugcuccccuugggacgccggauuucgugggaaaaauccagggcguccugacccagacaaccaagggggacggaucuacacggggccacaaggccaccguguacacgggguccgccccuuuuacacccaaacucggaagcguucaguucuccaccgacaccgaaaacgauuuugagacacaucaaaauaccaaguucacacccgugggcgucauucaggacggcgggacgacccaccgcaacgaaccucagcaaugggugcugccgucuuacagcggaagagauguucacaaugugcaucuugcccccgcugucgccccuacauuucccggcgagcagcuccuguucuuucgguccaccaugccuggguguagcggauaucccaacauggaccuggauugccugcucccucaggagugggugcagcacuucuaccaagaagcggcucccgcccagucugacguggcccugcuucgcuuuguuaauccggauacaggcagaguccuguucgaguguaaacuccauaaguccggguaugugaccguggcucacacgggccagcacgaccuggucaucccucccaacggauacuuucgguucgauagcugggugaaucaguucuauacccuugccccuaugggcaacgggacaggaagacgccgggcucuguga

SEQ ID NO: 26583 - RNA, 1623 nt, Artificial Sequence
  derived and/or modified sequence opt5 from capsid_protein_VP1__Norovirus__AGE89565
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagacgcccgccccucuugggacccccgauuucgugggaaaaauucagggcguccugacacagaccacaaagggggacggaucuacccggggccacaaggcuacgguguacacaggguccgccccguuuaccccuaaacucggaagcguucaguucuccaccgacacagaaaaugauuuugagacccaucaaaacacaaaguucacgcccgugggcgucauccaggacggcgggaccacacaccgcaaugaaccccagcaaugggugcugccuucuuacagcggaagagauguucacaacgugcaucuugccccggcugucgcccccaccuuuccuggcgagcagcuccuguucuuucgguccacaaugcccggguguagcggauauccuaauauggaccuggauugccugcucccccaggagugggugcagcacuucuaccaagaagcggcuccugcccagucugacguggcccugcuucgcuuuguuaaccccgauaccggcagaguccuguucgaguguaaacuccauaaguccggguaugugacgguggcucacaccggccagcacgaccuggucauuccgccuaauggauacuuucgguucgauagcugggugaaccaguucuauacacuugcccccaugggcaacgggaccggaagacgccgggcucuguga

SEQ ID NO: 26584 - RNA, 1623 nt, Artificial Sequence; identical to SEQ ID NO: 26475
  derived and/or modified sequence opt5 from capsid_protein_VP1__Norovirus__AGE89568

SEQ ID NO: 26585 - RNA, 1623 nt, Artificial Sequence; identical to SEQ ID NO: 26475
  derived and/or modified sequence opt5 from capsid_protein_VP1__Norovirus__AGE89571

SEQ ID NO: 26586 - RNA, 1623 nt, Artificial Sequence; identical to SEQ ID NO: 26475
  derived and/or modified sequence opt5 from capsid_protein_VP1__Norovirus__AGE89574

SEQ ID NO: 26587 - RNA, 1623 nt, Artificial Sequence; identical to SEQ ID NO: 26475
  derived and/or modified sequence opt5 from capsid_protein_VP1__Norovirus__AGE89577

SEQ ID NO: 26588 - RNA, 1623 nt, Artificial Sequence; identical to SEQ ID NO: 26508
  derived and/or modified sequence opt5 from capsid_protein_VP1__Norovirus__AGE89580

SEQ ID NO: 26589 - RNA, 1623 nt, Artificial Sequence; identical to SEQ ID NO: 26475
  derived and/or modified sequence opt5 from capsid_protein_VP1__Norovirus__AGE89583

SEQ ID NO: 26590 - RNA, 1623 nt, Artificial Sequence
  derived and/or modified sequence opt5 from capsid_protein_VP1__Norovirus__AGE89586
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugaccccaccauuaagcucaucgccaugcuguauacaccccuucgcgcuaacaacgccggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaauucuagauuucccauuccgcuugagaagcuguucacagggccuuccggagccuucgucgugcagccccagaacggccgguguaccacggacgggguucuccugggaacaacccaacugagcccugugaauaucugcacauuucgcggcgaugucacccauaucgcuggcucuagaaacuacaccaugaaucucgcgucccugaacuggaauaacuaugaccccacagaagaggugccugcuccccuugggacgccggauuucgucggaaaaauucagggcgugcugacccagacaaccaagggggacggaagcacacggggccacaaggccaccguuuacacggggucugccccuuuuacacccaaacucggauccgugcaguucagcaccgacaccgaaaaugauuuugagacacaucaaaacaccaaguucacacccgucggcgugauccaggacggcgggacgacccaccgcaaugaaccucagcaauggguucugccguccuacucuggaagagaugugcacaacguccaucuugcccccgcuguggccccuacauuucccggcgagcagcuccuguucuuucggagcaccaugccuggguguuccggauaucccaauauggaccuggauugccugcucccucaggagugggugcagcacuucuaccaagaagcggcucccgcccagagcgacguugcccugcuucgcuuugucaacccggauacaggcagagugcuguucgaguguaaacuccauaagucuggguaugugaccgucgcucacacgggccagcacgaccuggugauuccucccaauggauacuuucgguucgauuccuggguuaaccaguucuauacccuugccccuaugggcaacgggacaggaagacgccgggcucuguga

SEQ ID NO: 26591 - RNA, 1623 nt, Artificial Sequence; identical to SEQ ID NO: 26475
  derived and/or modified sequence opt5 from capsid_protein_VP1__Norovirus__AGE89589

SEQ ID NO: 26592 - RNA, 1623 nt, Artificial Sequence; identical to SEQ ID NO: 26475
  derived and/or modified sequence opt5 from capsid_protein_VP1__Norovirus__AGE89592

SEQ ID NO: 26593 - RNA, 1623 nt, Artificial Sequence; identical to SEQ ID NO: 26522
  derived and/or modified sequence opt5 from capsid_protein_VP1__Norovirus__AGE89595

SEQ ID NO: 26594 - RNA, 1623 nt, Artificial Sequence
  derived and/or modified sequence opt5 from capsid_protein_VP1__Norovirus__AGE89598
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucagaacgugcaccuugccccggcugucgcccccacauuuccuggcgagcagcuccuguucuuucgguccaccaugcccggguguagcggauauccuaauauggaccuggauugccugcucccccaggagugggugcaacauuucuaccaggaagcggcuccugcccagucugacguggcccugcuucgcuuuguuaaccccgauacaggcagaguccuguucgaguguaaacuccacaaguccggguaugugaccguggcucauacgggccagcacgaccuggucaucccgccuaauggauacuuucgguucgauagcugggugaaccaauucuauacccuugcccccaugggcaacgggacaggaagacgccgggcucuguga

SEQ ID NO: 26595 - RNA, 1623 nt, Artificial Sequence; identical to SEQ ID NO: 26475
  derived and/or modified sequence opt5 from capsid_protein_VP1__Norovirus__AGE89601

SEQ ID NO: 26596 - RNA, 1623 nt, Artificial Sequence; identical to SEQ ID NO: 26475
  derived and/or modified sequence opt5 from capsid_protein_VP1__Norovirus__AGE89604

SEQ ID NO: 26597 - RNA, 1623 nt, Artificial Sequence; identical to SEQ ID NO: 26475
  derived and/or modified sequence opt5 from capsid_protein_VP1__Norovirus__AGE89607

SEQ ID NO: 26598 - RNA, 1623 nt, Artificial Sequence; identical to SEQ ID NO: 26475
  derived and/or modified sequence opt5 from capsid_protein_VP1__Norovirus__AGE89610

SEQ ID NO: 26599 - RNA, 1623 nt, Artificial Sequence; identical to SEQ ID NO: 26508
  derived and/or modified sequence opt5 from capsid_protein_VP1__Norovirus__AGE89613

SEQ ID NO: 26600 - RNA, 1623 nt, Artificial Sequence
  derived and/or modified sequence opt5 from capsid_protein_VP1__Norovirus__AGE89616
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuaacgccuucgugguucagccccagaauggacgguguacaaccgauggcgugcuccuggggacgacacaacuguccccugucaacauuugcaccuuucgcggagacgugacacauauccccggcagcagaaauuacaccaugaaccucgccucucagaauuggaacuccuaugauccuaccgaggaaauccccgcuccgcugggcacaccugacuucgucgggaaaauucagggagugcuuacgcagaccacacggaccaauggcagcacacgcgggcacaaggcgaccguuuacacgggauccgccgacuuuucucccaagcugggcagagugcaauucgcuacagauaccgacaacgauuuugagaccaaucagaacacaaaauucacccccgucggggugauccaggacggaagcacaacgccucggaaugaaccgcaacaguggguucuccccuccuacagcggccgcgaugugcauaacguccaccuggccccugccguggcucccaccuuuccuggcgagcagcuucuguucuuuagaucuacaaugcccggguguuccggauauccuaauauggaccucgauugccugcugccccaggaaugggugcaauacuucuaucaggaggccgcgccggcucagagcgacguugcccuccugcgguuugucaacccugauaccggcagagugcuuuucgaguguaagcugcacaaaucuggguacgugacagucgcccauaccggacagcacgaccucgugauucccccuaacggcuauuuucgcuucgauagcuggguuaaucaauucuacacgcuggcucccauggggaacggcaccggacggagacgcgcccuuuga

SEQ ID NO: 26601 - RNA, 1623 nt, Artificial Sequence; identical to SEQ ID NO: 26522
  derived and/or modified sequence opt5 from capsid_protein_VP1__Norovirus__AGE89622

SEQ ID NO: 26602 - RNA, 1623 nt, Artificial Sequence
  derived and/or modified sequence opt5 from capsid_protein_VP1__Norovirus__AGE89625
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaucaaccagaauaccaaauucacacccgucggggugauucaggacggauccaccacaccucggaacgaaccgcaacaguggguucuccccagcuacucuggccgcaauauccauaacgugcaccuggccccugccgucgcucccacguuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacaggacagcacgaucucgucauucccccuaacggcuauuuucgcuucgacuccugggugaaucaauucuacacccuggcucccauggggaacggcacgggacggagacgcgcccuuuga

SEQ ID NO: 26603 - RNA, 1623 nt, Artificial Sequence
  derived and/or modified sequence opt5 from capsid_protein_VP1__Norovirus__AGE89628
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugagaccaaucagaacacaaaauucacccccgucggggugauccaggauggaggcacaacgcaucggaaugaaccccaacaguggguucucccuagcuacucuggccgcaacauucacaaugugcaccuggccccggccgucgcucccaccuuuccuggggagcagcuucuguucuuuagauccacaaugcccggauguagcggcuauccuaacauggaccucgauugccugcugccccaggaaugggugcaauacuucuaucaggaggccgcgccugcucagucugacguggcccuccugcgguuuguuaaucccgauaccgggagaguccuuuucgaguguaagcugcauaaaagcggauacgugacaguggcccacaccggccagcaugaccucgucaucccgccuaacggguauuuucgcuucgauuccugggugaaccaauucuacacgcuggcucccaugggcaauggaaccggccggagacgcgcccuuuga

SEQ ID NO: 26604 - RNA, 1623 nt, Artificial Sequence; identical to SEQ ID NO: 26475
  derived and/or modified sequence opt5 from capsid_protein_VP1__Norovirus__AGE89631

SEQ ID NO: 26605 - RNA, 1623 nt, Artificial Sequence; identical to SEQ ID NO: 26529
  derived and/or modified sequence opt5 from capsid_protein_VP1__Norovirus__AGE89634

SEQ ID NO: 26606 - RNA, 1623 nt, Artificial Sequence; identical to SEQ ID NO: 26475
  derived and/or modified sequence opt5 from capsid_protein_VP1__Norovirus__AGE89637

SEQ ID NO: 26607 - RNA, 1623 nt, Artificial Sequence; identical to SEQ ID NO: 26475
  derived and/or modified sequence opt5 from capsid_protein_VP1__Norovirus__AGE89640

SEQ ID NO: 26608 - RNA, 1623 nt, Artificial Sequence
  derived and/or modified sequence opt5 from capsid_protein_VP1__Norovirus__AGE89643
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaauggaugcugccuucuuacagcggaagagaugugcacaacguucaucuugccccggcuguggcccccacauuuccuggcgagcagcuccuguucuuucgguccaccaugcccggguguagcggauauccuaauauggaccuggauugccugcucccccaggaguggguccagcacuucuaccaagaagcggcuccugcccagucugacguggcccugcuucgcuuugugaaccccgauacaggcagaguucuguucgaguguaaacuccauaaguccggguaugucaccguggcucacacgggccagcacgaccuggugaucccgccuaauggauacuuucgguucgauagcugggucaaccaguucuauacccuugcccccaugggcaacgggacaggaagacgccgggcucuguga

SEQ ID NO: 26609 - RNA, 1623 nt, Artificial Sequence; identical to SEQ ID NO: 26475
  derived and/or modified sequence opt5 from capsid_protein_VP1__Norovirus__AGE89646

SEQ ID NO: 26610 - RNA, 1623 nt, Artificial Sequence
  derived and/or modified sequence opt5 from capsid_protein_VP1__Norovirus__AGE89649
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugaccccaccauuaagcucaucgccaugcuguauacaccccuucgcgcuaacaacgccggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaauucuagauuucccauuccgcuugagaagcuguucacagggccuuccggagccuucgucgugcagccccagaacggccgguguaccacggacgggguucuccugggaacaacccaacugagcccugugaauaucugcacauuucgcggcgaugucacccauaucgcuggcucuagaaacuacaccaugaaucucgcgucccugaacuggaauaacuaugaccccacagaagagauuccugcuccccuugggacgccggauuucgugggaaaaauccagggcguccugacccagacaaccaagggggacggaagcacacggggccacaaggccaccguguacacggggucugccccuuuuacacccaaacucggauccguucaguucagcaccgacaccgaaaaugauuuugagacacaucaaaacaccaaguucacacccgugggcgucauucaggacggcgggacgacccaccgcaaugaaccucagcaaugggugcugccguccuacucuggaagagauguucacaacgugcaucuugcccccgcugucgccccuacauuucccggcgagcagcuccuguucuuucggagcaccaugccuggguguuccggauaucccaauauggaccuggauugccugcucccucaggagugggugcagcacuucuaccaagaagcggcucccgcccagagcgacguggcccugcuucgcuuuguuaacccggauacaggcagaguccuguucgaguguaaacuccauaagucuggguaugugaccguggcucacacgggccagcacgaccuggucaucccucccaauggauacuuucgguucgauuccugggugaaccaguucuauacccuugccccuaugggcaacgggacaggaagacgccgggcucuguga

SEQ ID NO: 26611 - RNA, 1623 nt, Artificial Sequence
  derived and/or modified sequence opt5 from capsid_protein_VP1__Norovirus__AGE89652
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaugaucguggacgugagacaacucgagccuguccugaucccccugccugauguucggaacaauuuuuaucacuacaaccagagcaaugaccccaccauuaagcucaucgcuaugcuguauacaccccuucgcgccaacaacgcuggcgaugacguguucaccguguccugcagaguccugacacggccuagcccggauuuugacuucauuuuucucgugcccccuaccguugaaucucgcacgaaacccuucuccgugccuauccugaccgucgaggaaaugacaaauagcagauuucccauuccgcuugagaagcuguucaccgggccuucuuccgccuucgugguucagccccagaacggacgguguacaaccgauggcgugcuccuggggacgacacaacugagcccugucaauaucugcaccuuucgcggagacgugacacauauuaccggcucucacaacuacaccaugaaucucgccacacagaacuggaacuccuaugaucccacggaggaaaucccugcuccccugggcaccccggacuucgucgggaaaauccagggagugcuuacacagaccacaagagcggacggcagcacccgggggcauaaggccacgguuuacacaggauccgcugauuuugccccuaagcugggccgcgugcaauucgccaccgacaccaauaaugaucucggggcuaaccagaauacaaaauuuacccccgucggagugauucaggacggcggcacagcccacagaaacgagccccaacaguggguucugccuucuuacagcgggcgcaauucccacaacgugcaucuugcgccggcugucgcccccacguucccuggagaacagcugcucuuuuuccggagcaccaugcccggcuguucuggguauccuaauauggaucuggacugccugcucccccaggagugggugcaauacuuuuaucaggaagccgcuccugcccaguccgauguggcucugcuuagauucguuaaccccgacacaggacggguccuguuugaguguaagcuccacaaaagcggcuacgugaccguggcccauacagggcagcacgaucuggucaucccgccuaacggcuauuucagauuugacucuugggugaaucaauucuacacccuugcgcccaugggaaacggcacggggcgccggagagcccuguga

SEQ ID NO: 26612 - RNA, 1623 nt, Artificial Sequence; identical to SEQ ID NO: 26475
  derived and/or modified sequence opt5 from capsid_protein_VP1__Norovirus__AGE89655

SEQ ID NO: 26613 - RNA, 1623 nt, Artificial Sequence; identical to SEQ ID NO: 26475
  derived and/or modified sequence opt5 from capsid_protein_VP1__Norovirus__AGE89658

SEQ ID NO: 26614 - RNA, 1623 nt, Artificial Sequence; identical to SEQ ID NO: 26475
  derived and/or modified sequence opt5 from capsid_protein_VP1__Norovirus__AGE89661

SEQ ID NO: 26615 - RNA, 1623 nt, Artificial Sequence
  derived and/or modified sequence opt5 from capsid_protein_VP1__Norovirus__AGE89664
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaagaugacuuugagacacaucaaaauaccaaguucacacccgugggcgucauucaggauggcgggacgacccaccgcaacgaaccccagcaaugggugcugccuucuuacagcggaagagacguucacaaugugcaucuugccccggcugucgcccccacauuuccuggcgagcagcuccuguucuuucgguccaccaugcccggguguagcggauauccuaacauggaucuggacugccugcucccccaggagugggugcagcacuucuaccaagaagcggcuccugcccagucugauguggcccugcuucgcuuuguuaaucccgacacaggcagaguccuguucgaguguaaacuccauaaguccggguaugugaccguggcucacacgggccagcacgaucuggucaucccgccuaacggauacuuucgguucgacagcugggugaaucaguucuauacccuugcccccaugggcaacgggacaggaagacgccgggcucuguga

SEQ ID NO: 26616 - RNA, 1623 nt, Artificial Sequence; identical to SEQ ID NO: 26475
  derived and/or modified sequence opt5 from capsid_protein_VP1__Norovirus__AGE89667

SEQ ID NO: 26617 - RNA, 1623 nt, Artificial Sequence; identical to SEQ ID NO: 26475
  derived and/or modified sequence opt5 from capsid_protein_VP1__Norovirus__AGE89673

SEQ ID NO: 26618 - RNA, 1623 nt, Artificial Sequence
  derived and/or modified sequence opt5 from capsid_protein_VP1__Norovirus__AGE99603
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccagaugauccuugcuggcaacgccuuuacagcggggaaaauuaucuucgccgcugugccucccaauuuuccuacggagggacugucccccucucagguuaccauguucccgcauaucauuguggacgucagacaacucgagccugugcugaucccccugccugaugugcggaacaauuuuuaucacuacaaccagagcaaugaccccacaauuaagcucaucgccaugcuguauacaccccuucgcgcuaacaacgccggcgaugacgucuucaccguuuccugcagagugcugacccggccuagcccggauuuugacuucauuuuucucgugcccccuacagucgaaucucgcaccaaacccuucacggugccuguucugaccguggaggaaaugacaaauuccagauuucccaucccgcuugagaagcuguucaccgggccuagcucugccuucgucgugcagccccagaacggacgguguacaaccgauggcguucuccuggggacgacacaacuguccccugugaauauuugcaccuuucgcggagacgucacacauaucgcuggcagcagaaacuacaccaugaaucucgcgucucugaacuggaauaacuaugaucccaccgaggaaaucccugcuccccuuggcacaccggacuucguggggaaaauucagggaguccugacgcagaccacaaagggcgacggguccacccggggacacaaggccacaguguacaccggcagcgccgauuuuacgccuaaacucggguccguucaguucggaacagacaccgauaaugacuuugagacccaucaaaacacacgcuucacccccgugggcgucauccaggauggcgccacaacgcacagaaaugaaccccagcaaugggugcugccuucuuacagcgggcggaacguucacaaugugcaucuugcuccggccgucgcgcccaacuuuccuggagagcagcuccuguucuuucgcuccaccaugcccggcuguagcggguauccuaauauggaccuggauugccugcucccccaggaaugggugcagcacuucuaccaagaggcugccccugcccagucugacguggcucugcuuagauuuguuaaccccgauacaggacggguccuguucgaguguaagcuccauaaauccggcuaugugaccguggcccacacagggcagcacgaccuggucauuccgccuaacggcuacuuuagauucgauagcugggugaaucaguucuauacccuugcucccaugggaaacggcacggggcgccggagagcccuguga

SEQ ID NO: 26619 - RNA, 1623 nt, Artificial Sequence
  derived and/or modified sequence opt5 from capsid_protein_VP1__Norovirus__AGI17592
augaugauggccagcaacgacgcugcccccuccaaugauggcgcgaccgggcuggugccugagaucaaccacgaaacacucccgcuggagcccgucgcuggagccgccauugcugccccuguuacgggccagaauaacaucauugaccccuggaucagaaccaauuucgugcaagcuccuaacggggaauuuacagugucuccccggaauagcccuggagagauucuucugaaccucgaacugggcccggaucuuaaucccuaccuggcccaucucucccgcauguauaacggguacgcgggaggcgucgaggugcagguucugcuggccggcaaugcuuucaccgccgggaagauccucuuugcugccgugccucccaacuucccugucgaguuucugucucccgcgcagaucacaaugcuuccgcaccugauuguggacguuagaacccucgaaccuaucaugauuccccugccugaugugcggaauacauucuuucauuauaacaaucagcccgccaaccgcaugagacuugucgcuaugcuguacacgccccuccggagcaacggauccggcgacgauguguucacggugucuugccgcguccugaccagaccuacaccggacuuugaguucaccuaucugguucccccuagcguggaauccaaaacaaagcccuuuagccucccuauccugaccauuucugagcuuaccaauucccgguuccccgccccgaucgauagccuguacacagcucaaaacaauaaccucaaugugcagugucagaacgggcgcugcacccuggacggagagcuucagggcacaacccaacugcucccuucugggauuugugccuuuagaggaaaacugaccgccgauguccaccagucccaugacgaucgguggcacaugcagcugacaaaucucaacggcacgcccuucgacccuaccgaagacgugcccgcuccucugggcacacccgauuucaccgggcuucuguuuggaguugcgagccagcgcaauguggucucuaacccgaauacaaccagagcccacgaggcugugaucuccacgacaagcucccaauucguuccuaagcucggcucuaucaacuuugggagcaccuccgacgauuuccagcugcagcaacccaccaaauuuacacccgugggaauuaaggucgaaagcggccaugacuucgaucagugggcccuuccucgguauucugggcaccugacccucaauaugaaccuggccccgcccguggcuccuaauuuucccggagagcagcuccuguucuuucgcuccaacgucccuugcgccggcggcgugagcgacgggguuaucgauugucugcuuccccaggaauggauucaauacuucuaccaggagucugcgccuagccaguccgacguggcucugaucagauaugucaaccccgauacaggacggacgcucuuugaggccaagcugcauagaaccggcuacauuacaguggcccacucuggggacuauccgcugguugugccuagcaauggauacuuccgcuuugauuccugggucaaccaguucuauagccuugcucccaugggcaccgggaauggccggagacgcgugcaauga

SEQ ID NO: 26620 - RNA, 1650 nt, Artificial Sequence
  derived and/or modified sequence opt5 from capsid_protein_VP1__Norovirus__AGI17594
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacaauuagcccuagaaacggccccggggaggugcuucugaaucucgaacugggaccugagaucaacccguaccuugcucaccuggcccggauguauaauggcuacgcuggcggguucgaggugcaggucgugcucgccggaaacgcguuuacggccggcaaaaucauuuucgcugccauucccccuaauuuucccaucgauaaccuguccgcugcccagguuaccaugugcccucaugugaucgucgacgugcgccaacuggaacccguuaaucucccgaugccugaugugagaaacucuuucuuucacuauaaucaggggacagacagccggcugcgccuuauugccaugcuguacacaccccucagagcuaacaacuccggagaugacgucuucaccgugucuugucgggugcugacccgcccuagccccgauuuuuccuucaauuuucuuguucccccuacagucgagagcaagaccaaaccguucacgcugcccauccucaccauuucugaaauguccaacagcagauuuccugugcccaucgacucucugcauacauccccuaccgauaauaucgugguccagugccagaacggccgggugacacuggacggggagcucaugggaaccacgcaacugcuucccagccagauuugugcguuccgcggcguucugacacagagaaccucucgggccuccgaucaggcugacacagccgugaccccgcgcgccuucgaccacagauggcauauccaacucgauaaucugaacggcacccacuaugacccuagcgaggauauucccgggccucuuggaauccccgacuuucggggccgcgucuacgggguggcuucccagagaaauucugauggaagcacacgggcccacgaagcgaagauugacacgaccuccagcagauucacaccuaaacugggcucucucgagaucuccaccgaaagcgaugacuuugaugagaacaagcccacacgcuucaccccgguugggaucggaguggacaaugaacgggaguuucagcaauggucucugccugauuauagcggccaguucacgcauaacaugcaccuggcucccgccgucgcccccaauuuuccuggcgagcagcuccuguucuuuagaucccaucuuccgucuagcgggggauggguggacggcacacuggacugccuccugccccaggaauggauucaacacuucuaccaggaguccgcuccuagccagacccaggucgcccuugugcgcuacguuaaccccgauaccgggcgggugcuguuugaagcuaagcuccacaaaucuggauucaugacaaucgccagauccggcgacagcccuauuaccgugcccccuaauggguauuuucgcuucgagucuugggucaaccccuucuacacacuggcgccgaugggcacgggaaauggccggagacgcauccaauga

SEQ ID NO: 26621 - RNA, 1623 nt, Artificial Sequence
  derived and/or modified sequence opt5 from capsid_protein_VP1__Norovirus__AGK36311
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcucugccuucgucgugcagccucagaacggacgcuguaccacggacggcguucuccuggggacaacccagcugucccccgugaauaucugcacauuuagaggagaugucacccauaucgcuggcagccggaacuacaccaugaaucucgcgucucugaacuggaauaacuaugacccuacagaagagauucccgccccucuuggcacgcccgauuucguggggaaaauccaaggaguccugacccagacaaccaagggcgacggguccacacgcggacacaaggcuaccguguacacgggcagcgccccguuuacaccuaaacucggguccguucaguucucuaccgacaccgaaaaugauuuugagauucaucagaacacaaaguucacccccgugggagucauccaagacggcggcacaacgcacagaaaugaaccccagcagugggugcugccuagcuacuccgggcgggauguucacaacgugcaucuugccccggcugucgcccccaccuuuccuggagagcaacuccuguucuuucgcagcacaaugcccggcuguucuggguauccuaauauggaccuggauugccugcucccccaggagugggugcagcacuucuaccaggaagcggcuccugcccaauccgacguggcccugcuuagauuuguuaaccccgauaccggacggguccuguucgaguguaaacuccauaagagcggcuaugugacaguggcucacaccgggcagcacgaccuggucauuccgccuaauggcuacuuuagauucgauucuugggugaaccaguucuauacgcuugcccccaugggaaacggcaccgggcgccggagagcucuguga

SEQ ID NO: 26622 - RNA, 1623 nt, Artificial Sequence; identical to SEQ ID NO: 26522
  derived and/or modified sequence opt5 from capsid_protein_VP1__Norovirus__AGK36314

SEQ ID NO: 26623 - RNA, 1593 nt, Artificial Sequence
  derived and/or modified sequence opt5 from capsid_protein_VP1__Norovirus__AGM33208
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucggcagcgggaauuaugucggagugcugucuuggauuagcccgcccucccauccuucuggcagccaaguugaccuguggaagauccccaacuacggguccagcauuacggaggccacacaccucgcccccucuguguauccuccgggcuucggagaaguccugguguuuuucauguccaaaaugcccggcccuggggcuuacaaucuucccugucugcucccucaggaguauaucagccaccuggcgucugaacaggcccccaccguuggagaggcugcccuucugcauuacguggauccugacaccggccggaaccucggggaguuuaaggccuaccccgauggauuccugacaugcgucccgaauggcgcuuccagcgggccucagcaacugcccaucaacggcguguuuguguucguuuccugggucucucgcuuuuaucagcucaagccugugggaaccgccagcuccgcgagaggccggcuggggcuucgcagauga

SEQ ID NO: 26624 - RNA, 1593 nt, Artificial Sequence
  derived and/or modified sequence opt5 from capsid_protein_VP1__Norovirus__AGM33214
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucaacaccacacccgacaccuuugugccucaccucggguccauucaggcuaauggaaucggcagcgggaacuaugucggagugcugucuuggauuagcccgcccucccauccuucuggcagccaaguugaucuguggaagauccccaauuacggguccagcauuacggaggccacacaccucgcccccucuguguauccuccgggcuucggagaaguccugguguuuuucauguccaaaaugcccggcccuggggcuuacaaccuucccugucugcucccucaggaguauaucagccaccuggcgucugaacaggcccccaccguuggagaggcugcccuucugcauuacguggacccugauaccggccggaaucucggggaguuuaaggccuaccccgacggauuccugacaugcgucccgaacggcgcuuccagcgggccucagcaacugcccaucaauggcguguuuguguucguuuccugggucucucgcuuuuaucagcucaagccugugggaaccgccagcuccgcgagaggccggcuggggcuucgcagauga

SEQ ID NO: 26625 - RNA, 1593 nt, Artificial Sequence; identical to SEQ ID NO: 26623
  derived and/or modified sequence opt5 from capsid_protein_VP1__Norovirus__AGM33217

SEQ ID NO: 26626 - RNA, 1593 nt, Artificial Sequence
  derived and/or modified sequence opt5 from capsid_protein_VP1__Norovirus__AGM33220
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggagucggcagcgggaauuaugugggaguucugucuuggaucagcccgcccucccauccuucuggcagccaaguggaccuguggaagauucccaacuacggguccagcaucacggaggccacacaccucgcccccucugucuauccuccgggcuucggagaagugcugguguuuuucauguccaaaaugcccggcccuggggcuuacaaucuucccugucugcucccucaggaguauauuagccaccuggcgucugaacaggcccccaccguuggagaggcugcccuucugcauuacgucgauccugacaccggccggaaccucggggaguuuaaggccuaccccgauggauuccugacaugcgugccgaauggcgcuuccagcgggccucagcaacugcccaucaacggcguguuuguuuucgucuccugggugucucgcuuuuaucagcucaagccugugggaaccgccagcuccgcgagaggccggcuggggcuucgcagauga

SEQ ID NO: 26627 - RNA, 1593 nt, Artificial Sequence
  derived and/or modified sequence opt5 from capsid_protein_VP1__Norovirus__AGM33226
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauauuuuugugccucaccucggguccauccaggcuaacggaauuggcagcgggaauuaugucggagugcugucuuggaucagcccgcccucccauccuucuggcagccaaguugaccuguggaagauucccaacuacggguccagcaucaccgaggccacgcaccucgcccccucuguguauccuccgggcuucggagaaguccugguguuuuucauguccaaaaugcccggcccuggggcuuacaaucuucccugucugcucccucaggaguauaucagccaccuggcgucugaacaggcccccacaguuggagaggcugcccuucugcauuacguggauccugacaccggccggaaccucggggaguuuaaggccuaccccgauggauuccugaccugcgucccgaauggcgcuuccagcgggccucagcaacugcccauuaacggcguguuuguguucguuuccugggucucucgcuuuuaucagcucaagccugugggaacagccagcuccgcgagaggccggcuggggcuucgcagauga

SEQ ID NO: 26628 - RNA, 1593 nt, Artificial Sequence
  derived and/or modified sequence opt5 from capsid_protein_VP1__Norovirus__AGM33229
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgugaccuuugucccucaccucggguccauucaggcuaacggaaucggcagcgggaauuaugugggaguucugucuuggauuagcccgcccucccauccuucuggcagccaaguggaucuguggaagauccccaacuacggguccagcauuacggaggccacacaccucgcccccucugucuauccuccgggcuucggagaagugcugguguuuuucauguccaaaaugcccggcccuggggcuuacaaucuucccugucugcucccucaggaguauaucagccaccuggcgucugaacaggcccccaccguuggagaggcugcccuucugcauuacgucgacccugauaccggccggaaccucggggaguuuaaggccuaccccgacggauuccugacaugcgugccgaauggcgcuuccagcgggccucagcaacugcccaucaacggcguguuuguuuucgucuccugggugucucgcuuuuaucagcucaagccugugggaaccgccagcuccgcgagaggccggcuggggcuucgcagauga

SEQ ID NO: 26629 - RNA, 1593 nt, Artificial Sequence
  derived and/or modified sequence opt5 from capsid_protein_VP1__Norovirus__AGM33232
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuuccaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucggcagcgggaauuaugucggagugcugucuuggauuagcccgcccucccggccuucuggcagccaaguugaccuguggaagauccccaacuacggguccagcauuacggaggccacacaucucgcccccucuguguauccuccgggcuucggagaaguccugguguuuuucauguccaaaaugcccggcccuggggcuuacaaucuucccugucugcucccucaggaguauaucagccaccuggcgucugaacaggcccccaccguuggagaggcugcccuucugcacuacguggauccugacaccggccgcaaccucggggaguuuaaggccuaccccgauggauuccugacaugcgucccgaauggcgcuuccagcgggccucagcaacugcccaucaacggcguguuuguguucguuuccugggucucuagauuuuaucagcucaagccugugggaaccgccagcuccgcgcggggccgccuggggcuuagacgguga

SEQ ID NO: 26630 - RNA, 1593 nt, Artificial Sequence; identical to SEQ ID NO: 26629
  derived and/or modified sequence opt5 from capsid_protein_VP1__Norovirus__AGM33235

SEQ ID NO: 26631 - RNA, 1593 nt, Artificial Sequence
  derived and/or modified sequence opt5 from capsid_protein_VP1__Norovirus__AGM33238
augaugauggccagcaaggacgcuaccuccucuguggauggcgccagcggggcgggacagcugguccccgagguuaacgcuuccgacccucucgccauggauccgguggccggcucuagcacagcuguggccacgaccgggcaagucaaucccaucgacccuuggauuaucaacaauuucgugcaggcuccccagggagaauuuacaauuuccccuaacaauacccccggcgauguucuguucgaccuuucucuggggccucaccucaacccguuucugcuucaucugagccagauguacaauggaugggugggcaacaugagaguccggaucaugcucgccggcaaugcguucacagccgggaaaauuaucguguccugcauucccccuggauuuggcagccacaaccugaccaucgcucaagccacacuguucccccauguuaucgcugaugugcgcacccucgacccuauugaggucccccuggaagaugugagaaaugugcuuuuucacaacaaugaccggaaccagcagacgaugcgccuggucuguaugcucuauaccccgcugagaacagggggaggcaccggggauucuuucguuguggccggacgggugaugacaugcccuucccccgacuuuaauuuccuuuuucuggucccucccaccguggagcagaagacgcgccccuucacacucccuaaccugccgcugagcucucucuccaacagcagagcgccccugccuaucucuuccaugggcauuagccccgauaauguucaauccgugcaguuucagaacggccgguguacccuugacgggcgccuggucggaacaaccccugugucucucagccauguugccaaaaucagaggcaccuccaaugggacagugauuaaccugacggaacuugacggaacccccuuccacccguucgagggcccugcucccaucggguuuccugaucugggaggcugcgacuggcacaucaauaugacacaguucggccauagcucucaaacccaguacgaugucgacacaacccccgauacguuugugccucaccucggguccauucaggccaacggaaucggcagcgggaauuaugucggagugcugucuuggauuagcccgcccucccauccuucuggcagccaaguugaccuguggaagauccccaacuacggguccagcauuacagaggcuacccaccucgcccccucuguguauccuccgggcuucggagaaguccugguguuuuucauguccaaaaugcccggcccuggggccuacaaucuucccugucugcucccucaggaguauaucagccaccuggcuucugaacaggcgcccaccguuggagaggccgcccuucugcauuacguggauccugacacaggccggaaccucggggaguuuaaggcuuaccccgauggauuccugaccugcgucccgaauggcgccuccagcgggccucagcaacugcccaucaacggcguguuuguguucguuuccugggucucucgcuuuuaucagcucaagccugugggaacagcuagcuccgccagaggccggcuggggcuucgcagauga

SEQ ID NO: 26632 - RNA, 1593 nt, Artificial Sequence; identical to SEQ ID NO: 26623
  derived and/or modified sequence opt5 from capsid_protein_VP1__Norovirus__AGM33241

SEQ ID NO: 26633 - RNA, 1593 nt, Artificial Sequence; identical to SEQ ID NO: 26624
  derived and/or modified sequence opt5 from capsid_protein_VP1__Norovirus__AGM33244

SEQ ID NO: 26634 - RNA, 1626 nt, Artificial Sequence
  derived and/or modified sequence opt5 from capsid_protein_VP1__Norovirus__AGO59890
augagaaugagcgacggcgccgcucccaaggccaacggguccgaggcgucuggacaggaucuggugccugcugccgucgaacaagccguuccgauccagcccguggcuggcgccgcucucgccgcgccugccgcugggcagauuaaucagaucgaccccuggauuuuccaaaacuuugugcagugcccucugggagaguucagcaucagcccccggaauaccccuggcgaaauucuuuuugaucuggcccucgggccgggacugaaccccuaccuugcucaccugucugccauguauacaggcugggucggcaauauggaggugcagcucguucuggcggggaacgccuucacggcuggaaaaguggucguggcccugguuccucccuacuuuccuaagggcagccucaccacagcucagaucaccuguuucccccaugugaugugcgacguccgcacacuggaaccgauccaacuuccucugcucgaugugagacgggugcuguggcacgccacccaggaccaggaggaguccaugcgccuugucuguaugcuguauacaccccucagaaccaauucuccuggggaugaauccuuuguuguguccggacggcugcugagcaaacccgccgcugacuucaacuuuguguaccucacgcccccuauugagcgcaccaucuauagaauggucgaucugccggugauucagccccggcuuugcacacaugcgcgcuggccugcccccguuuacggccugcucguggacccuucucugcccuccaauccgcaauggcagaacgggagaguccacguggauggaacccuucugggcacaaccccuaucagcggcucuuggguuuccuguuucgcugccgaagccgcuuauaaguuucagagcgggauuggagagguggccacguucacacucaucgagcaagacggcucugcguacguccccggggaucgggcugccccucugggauaccccgacuuuuccggccagcuggaaauugaggugcagaccgaaacaaccaaaaccggggacaagcucaaggucacaacguucgagaugauccugggaccuaccacaaaugccgaucaggcucccuaucaaggccgcguguucgccagcguuaccgcugccgcgucccuugaccugguggauggcagaguccgggccgugccgcgcucuaucuacggguuucaggacacaauuccugaauauaacgauggacuccugguuccccuugcucccccuaucggcccguuccugcccggggaggugcuccugagauuucggaccuacaugagacagauugacacggccgaugcugccgcggaggccaucgacugcgcucugccucaggaguucgucagcugguuugccuccaaugcuuucacagugcaaagcgaagcccuccugcuucgcuaucggaacacccugaccggacagcuccuguuugaauguaaacuguacaaugagggcuauauugcccuuucuuacuccgggagcggcccccucacauucccuaccgauggaaucuuugaagugguuucuuggguccccagacuguaccagcuggcuagcgugggcucccucgcgacagggcgcaugcugaagcaguga

SEQ ID NO: 26635 - RNA, 1620 nt, Artificial Sequence
  derived and/or modified sequence opt5 from capsid_protein_VP1__Norovirus__AGT17782
augaagauggccagcaacgacgcuacccccuccgauggcucuagcgccaaucuggugccugaggucaacaaugaaguuauggcgcucgagccgguggcuggggccgccaucgcugcccccguggcuggacagcaaaacgucauugacccuuggaucagaaauaacuucgugcaggcccccggcggggaauuuacaguuuccccucggaaugcgcccggagagauucuguggucugccagccuuggcccugaucugaacccguaccucucccaccugucucgcauguauaauggguacgcuggcagcuucgaagugcaggucauccuugccggaaacgcuuuuacggccggcaaaauuaucuucgcggccgugcccccuaauuuuagaaccgaggggcugucccccagccagaucacaauguucccucauauuaucaccgacguucggcaacucgagcccgugcugauuccgcugccugauauccgcaacaauuuuuaucacuacaaccagucuaaugaccccacaauuaagcucaucgcuaugcuguauaccccucuuagagccaacaacgcuggagaugacgucuucacaguguccugccgggugcugacccgccccagccccgauuuugacuucauuuuucucgucccuccgacgguugaaucuagaaccaaacccuucuccgugccugugcugacagucgaggaaaugaccaauagccgguuucccaucccucuugagaagcuguucacaggccccucuuccgccuucgugguucagccgcagaacgggcgcuguaccacggauggagugcuccugggcacaacccaacugagcccugucaauaucugcacauuuagaggggacgugacccggauuggaaacucccgcgaguacagaaugaaucucgccucucugaacuggaauaacuaugaucccaccgaagagaucccugcuccccuuggcacaccugacuucgcgggcaaaauucaggggguucugacgcagaccacacggcaugacggaagcacccgcggccacaaggccacaguguacaccggguccgcuggauuuacgcccaagcucggcagcguccaguucucuacagauaccgacaaugaucuggaagccaaccaaaauaccagauuuacaccggugggggucauccaggacggaaacgcccaucagggcgagccucaacagugggugcuucccaauuacgcuggccgggaugggcacaacguucaccuggcccccgcgguggcuccuaccuucccgggagaacagcuccuguuuuucagauccacaaugcccggcuguagcggguauccuaauaugaaccuggacugccuccugccccaggaguggguccaacauuuuuaccaggagucugccccugcccagagcgauguggcccuucugcgcuucguuaaccccgacacgggacgggugcucuuugaauguaaacugcacaaguccggcuaugucaccguggcucauacagggccucacgaucuugugauucccccgaauggcuacuucagauuugacucuuggguuaaccaguucuauacccuggcuccuaugggaaauggcgccgggcgccggagagcgcucuga

SEQ ID NO: 26636 - RNA, 1593 nt, Artificial Sequence; identical to SEQ ID NO: 26623
  derived and/or modified sequence opt5 from capsid_protein_VP1__Norovirus__AGT17785

SEQ ID NO: 26637 - RNA, 1623 nt, Artificial Sequence
  derived and/or modified sequence opt5 from capsid_protein_VP1__Norovirus__AGT17788
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucaccggcucuagaaauuacaccaugaaccucgccucccagaauuggaacagcuaugauccuacagaggaaauucccgcuccucugggcacgcccgacuucguggggaaaauccagggaguccuuacccagacaacccggacagacggcuccacccgcgggcacaaggcgacgguguacacaggaucugccgauuuuagcccgaagcugggcagaguucaauucgcuaccgacaccgauaaugacuuugaugccaaccagaauacaaaauucaccccugugggggucauucaggacggaggcacaacgcaucggaacgagccccaacagugggugcuccccuccuacagcggccgcaauacccacaacguucaccuggccccugcuguggccccgacauuucccggggaacagcuucuguucuuuagaucuaccaugccuggauguuccggcuaucccaauauggaucucgacugccugcugccucaggaguggguccaacauuucuaccaggaagcggcucccgcccagagcgauguggcccuccugcgguuugugaacccugacacagggagaguucuuuucgaguguaagcugcacaaaucuggauaugucaccguggcucauacgggccagcacgaucucgugauucccccgaacggguacuuucgcuucgacagcugggucaaucaauucuauacccuggccccuaugggcaacggaacaggccggagacgcgcuguguga

SEQ ID NO: 26638 - RNA, 1593 nt, Artificial Sequence; identical to SEQ ID NO: 26623
  derived and/or modified sequence opt5 from capsid_protein_VP1__Norovirus__AGT17792

SEQ ID NO: 26639 - RNA, 1623 nt, Artificial Sequence
  derived and/or modified sequence opt5 from capsid_protein_VP1__Norovirus__AGT17795
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaucaaucagaacaccaaauucacacccguggggguuauucaggauggaagcaccacaccccggaaugagccucaacagugggugcucccgucuuacuccggccgcaacacgcauaauguccaccuggcccccgccguggcuccuaccuuucccggcgaacagcuucuguucuuuagaagcacaaugccuggguguucuggauaucccaacauggaccucgauugccugcugccucaggagugggugcaauacuucuaucaggaagccgcgcccgcucagagcgacguugcccuccugcgguuugucaauccggauaccggcagagugcuuuucgaguguaagcugcacaaauccggguacgugacagucgcccauaccggacagcacgaccucgugaucccucccaacggcuauuuucgcuucgauucuuggguuaaccaauucuacacgcuggcuccuauggggaauggcaccggacggagacgcgcccuuuga

SEQ ID NO: 26640 - RNA, 1617 nt, Artificial Sequence
  derived and/or modified sequence opt5 from capsid_protein_VP1__Norovirus__AGT17798
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuuccacggagggacugucuccuagccaggugaccauguucccccaucucaucgucgacgugagacaacuggagccggugaugaucccucugcccgauauucggaacaauuuuuaucacuacaaccaguccaaugacccuacaaucaagcucauugcuaugcuguauacaccccuucgcgccaacaacgucggcgaugacguuuucaccgugagcugcagagugcugacccggcccucuccugauuuugacuucaucuuucucgucccgcccacaguggaauccaaaaccaauccuuucagcguucccauucugacgaucgaggaaaugaccaacucucgcuuuccuauuccccuugagaagcuguucacagggccguccagcgcccucgugguccagccucagaauggaagauguaccacagauggcgugcugcuggggaccacgcaacucucucccguuaacaucugcacauuccggggagacgugacccauacaaccaaaacccacacauaccagaugaaucuggcugcgcagaacuggaacuccuaugauccuacggaggaaacccccgccccucuuggcacacccgacuuugucggcaagauccagggggugcugacccaaacaaccaagggaaauggcagcacgcgcgcucauaaagccacagucuacaccgggaccguggaguucacaccgaagcucggacggauucagcuguuuaccgacacagauaaugaccuugaagccaaccagaauacgaaauucaccccuguuggcgugauccaagauggggaccaccagaacgagccccagcaguggguccugcccuccuacucuggaagaaauaaccacaaugugcaucucgcuccugccguugcgccgacauuucccggcgaacaacugcuguucuuucgcagcaccaugccuggcuguuccggguaucccaacaugaaccucgauugccugcuuccucaggagugggugcaguacuucuaucaggaggcugcccccgcccaaagcgacgucgcucugcucagauuugugaauccugauacaggacgggugcuguucgaauguaaacuucacaagucuggcuacguuaccgucgcccauacggggcaccacgaccuggugauucccccgaacggauauuuucgcuucgauuccugggugagcccuuuuuacacccucgcucccaugggcaaugggacaggcagacggagagcccuguga

SEQ ID NO: 26641 - RNA, 1593 nt, Artificial Sequence; identical to SEQ ID NO: 26623
  derived and/or modified sequence opt5 from capsid_protein_VP1__Norovirus__AGT17803

SEQ ID NO: 26642 - RNA, 1593 nt, Artificial Sequence; identical to SEQ ID NO: 26623
  derived and/or modified sequence opt5 from capsid_protein_VP1__Norovirus__AGT17806

SEQ ID NO: 26643 - RNA, 1593 nt, Artificial Sequence; identical to SEQ ID NO: 26623
  derived and/or modified sequence opt5 from capsid_protein_VP1__Norovirus__AGT17809

SEQ ID NO: 26644 - RNA, 1623 nt, Artificial Sequence
  derived and/or modified sequence opt5 from capsid_protein_VP1__Norovirus__AGT17813
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucgccggcucuagaaauuacaccaugaaccucgcuucccagaauuggaacagcuaugauccuaccgaggaaauucccgcgccucugggcacacccgacuucguggggaaaauccagggaguccuuacgcagaccacacggaccgacggcuccacacgcgggcacaaggccaccguguacacgggaucugcugauuuuagcccgaagcugggcagaguucaauucgccacagacaccgauaaugacuuugaugccaaccagaauaccaaauucacaccugugggggucauucaggacggaggcaccgcucaucggaacgagccccaacagugggugcuccccuccuacagcggccgcaauacacacaacguucaccuggccccugcgguggcuccgacguuucccggggaacagcuucuguucuuuagaucuaccaugccuggauguuccggcuaucccaauauggaucucgacugccugcugccucaggaguggguccaauacuucuaucaggaagccgcccccgcucagagcgauguggcccuccugcgguuugugaacccugacacagggagaguucuuuucgaguguaagcugcauaaacccggauacgucaccguggcucacacaggccagcaugaucucgugaucccgccuaacggguauuuucgcuucgacucuugggucaaucaauucuacacccuggcccccaugggcaacggaacgggccggagacgcgcgcuuuga

SEQ ID NO: 26645 - RNA, 1623 nt, Artificial Sequence
  derived and/or modified sequence opt5 from capsid_protein_VP1__Norovirus__AGT17816
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucacgguucccauccugaccguggaggaaaugacaaacucuagauuuccuauuccccuugagaagcuguucaccgggccguccagcgccuucgucgugcagccucagaauggacgguguacaaccgauggcguucuccuggggacgacacaacugucucccgugaacaucugcaccuuucgcggagacgucacacauaucgcuggcuccagaaauuacaccaugaaccucgcgagccugaauugguccaacuaugauccuaccgaggaaauucccgccccucuuggcacacccgacuucguggggaaaauccagggaguccugacgcagaccacaaagggcgacgggucuacccggggacacaaggcuacaguguacaccggcagcgccgauuuuacgccgaaacucggguccguucaguucgccacagacaccgagaaugauuuugaaacccaucaaaacacacgcuucaccccugugggagucauucaggacggcggcacaacgcacagaaaugagccccagcaaugggugcugcccagcuacucugggcggaacguucacaaugugcaucuugcuccugccgucgcgccgaacuuucccggagaacagcuccuguucuuucgcuccaccaugccuggcuguagcggguaucccaauauggaucuggacugccugcucccucaggagugggugcagcacuucuaccaagaggcugcccccgcccagucugauguggcucugcuuagauuuguuaacccugacacaggacggguccuguucgaauguaagcuccauaaaagcggcuaugugaccguggcccacacagggcagcacgaucuggucauucccccgaauggcuacuuuagauucgacuccugggugaaccaguucuauacccuugcuccuaugggaaacggcacggggcgccggagagcccuguga

SEQ ID NO: 26646 - RNA, 1623 nt, Artificial Sequence
  derived and/or modified sequence opt5 from capsid_protein_VP1__Norovirus__AGT17819
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucgccggcucuagaaacuacaccaugaaucucgcuucccagaacuggaauagcuaugaucccaccgaggaaaucccugcgccccugggcacaccggacuucgucgggaaaauucagggagugcuuacgcagaccacacggaccgacggcuccacacgcgggcacaaggccaccguuuacacgggaucugcugauuuuagcccuaagcugggcagagugcaauucgccacagacaccgauaacgacuuugucaccaaucagaacacaaaauucacccccguggggguuauccaggauggaggcacaacgccccggaaugagccucaacagugggugcucccguccuacagcggccgcaacacccauaauguccaccuggcccccgcuguggccccuacauuucccggggaacagcuucuguucuuuagaucuaccaugccuggauguuccggcuaucccaacauggaccucgauugccugcugccucaggagugggugcaauacuucuaucaggaagcggcucccgcccagagcgacguugcccuccugcgguuugucaauccggauacagggagagugcuuuucgaguguaagcugcacaaaucuggauacgugaccgucgcucauacgggccagcacgaccucgugauuccucccaacggguauuuucgcuucgauagcuggguuaaccaauucuacacccuggccccuaugggcaauggaacaggccggagacgcgcucuuuga

SEQ ID NO: 26647 - RNA, 1623 nt, Artificial Sequence
  derived and/or modified sequence opt5 from capsid_protein_VP1__Norovirus__AGT17823
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccucugcugaucccccucccugaugugcggaacaauuuuuaucacuacaaccagagcaaugaccccaccauuaagcugaucgcuaugcuuuauacaccccugcgcgccaacaacgcuggcgaugacgucuucaccguuuccugcagagugcucacacggccuagcccggauuuugacuucauuuuucuggugcccccuaccgucgaaucucgcacgaaacccuucuccgugccuauccuuaccauugaggaaaugacaaauagcagauuucccaucccgcuggagaagcuguucaccgggccuucuuccgccuucguugugcagccccagaacggacgguguacaaccgauggcguccugcuggggacgacacaacucagcccugugaauaucugcaccuuucgcggagacguuacacauauuaccggcacccacaacuacgccaugaaucuggcugcgcagaacuggaacucuuaugaucccacagaggaaaucccugcuccccuuggcacgccggacuucguggggaaaauucagggaguccugacccagacaaccagagccgacggcuccacacgggcccauaaggccaccguguacacggggagcgcugaguuugccccuaagcucggacgcguccaauucgcgacagauaccgacuccgauuuugacaccaaucagaauacaaaauucacccccgugggcguuauccaggaugggaacacagcucaccaaaaugaaccccagcagugggugcugccuucuuacagcggaagaaacaaucacaacguccaucuugccccggccguggcucccacguuuccuggcgagcagcuccucuucuuucgguccaccaugcccggcuguagcggguauccuaauaugaaccuggacugccugcucccccaagaauggguucaguacuucuaucaggaggccgcuccugcccagucugauguggcgcugcuucgcuuugucaaccccgacacaggaagagugcuguucgaguguaagcuccacaaauccggcuacgugaccguugcccauacagggcaacacgaucuggucauuccgccuaauggauauuuucgguucgacagcugggugucucccuucuacacccuugcuccuaugggcaacgggacgggcagacgccgggcccuguga

SEQ ID NO: 26648 - RNA, 1593 nt, Artificial Sequence; identical to SEQ ID NO: 26623
  derived and/or modified sequence opt5 from capsid_protein_VP1__Norovirus__AGT17826

SEQ ID NO: 26649 - RNA, 1620 nt, Artificial Sequence
  derived and/or modified sequence opt5 from capsid_protein_VP1__Norovirus__AGT17830
augaagauggccagcaacgacgcuacccccuccgauggcucuagcgccaaucuggugccugaggcgaacaaugaagucauggcucucgagccgguugccggggccgcuaucgccgcucccguggccggacagcaaaacgugauugacccuuggaucagaaauaacuucguccaggcgcccggcggggaauuuacaguguccccucggaaugcccccggagagauucuguggucugcuagccuuggcccugaucugaacccguaccucucccaccugucucgcauguauaauggguacgccggcagcuucgaaguucaggugauccuugcuggaaacgccuuuacggcgggcaaaauuaucuucgccgcugugcccccuaauuuuagaaccgaggggcugucccccagccagaucacaauguucccucauauuaucaccgacguccggcaacucgagcccguucugauuccgcugccugauauccgcaacaauuuuuaucacuacaaccagucuaaugaccccacaauuaagcucaucgccaugcuguauaccccucuuagagcuaacaacgccggagaugacguguucacagucuccugccgggugcugacccgccccagccccgauuuugacuucauuuuucucgugccuccgacggucgaaucuagaaccaaacccuucuccguuccugugcugacaguggaggaaaugaccaauagccgguuucccaucccucuugagaagcuguucacaggccccucuuccgccuucgucgugcagccgcagaacgggcgcuguaccacggauggaguucuccugggcacaacccaacugagcccugugaauaucugcacauuuagaggggacgucacccggauuggaaacucccgcgaguacagaaugaaucucgcuucucugaacuggaauaacuaugaucccaccgaagagaucccugcgccccuuggcacaccugacuucgccggcaaaauucagggggugcugacgcagaccacacggcaugacggaagcacccgcggccacaaggcuacaguuuacaccggguccgccggauuuacgcccaagcucggcagcgugcaguucucuacagauaccgacaaugaucuggaagccaaccaaaauaccagauuuacaccggucggggugauccaggacggaaacgcucaucagggcgagccucaacaguggguccuucccaauuacgccggccgggaugggcacaacgugcaccuggcgcccgcuguugccccuaccuucccgggagaacagcuccuguuuuucagauccacaaugcccggcuguagcggguauccuaauaugaaccuggacugccuccugccccaggagugggugcaacauuuuuaccaggagucugccccugcucagagcgaugucgcccuucugcgcuucgugaaccccgacacgggacggguucucuuugaauguaaacugcacaaguccggcuaugugaccgucgcucauacagggccucacgaucuugugauucccccgaauggcuacuucagauuugacucuugggugaaccaguucuauacccuggccccuaugggaaauggcgcggggcgccggagagcccucuga

SEQ ID NO: 26650 - RNA, 1623 nt, Artificial Sequence
  derived and/or modified sequence opt5 from capsid_protein_VP1__Norovirus__AGT17833
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucgccggcuccagaaacuacaccaugaaucucgcuagccagaacuggaacuccuaugauccuaccgaggaaauccccgcgccucugggcacacccgacuucgucgggaaaauucagggagugcuuacgcagaccacacggaccgacggcucuacacgcgggcacaaggccaccguuuacacgggaagcgcugauuuuuccccgaagcugggcagagugcaauucgccacagacaccgauaaugacuuugucaccaaucagaacacaaaauucaccccuguggggguuauccaggauggaagcacaacgccccggaaugagccccaacagugggugcucccuucuuacuccggccgcaacacccauaauguccaccuggccccggcuguggcccccacauuuccuggcgaacagcuucuguucuuuagaagcaccaugcccggguguucuggauauccuaacauggaccucgauugccugcugccccaggagugggugcaauacuucuaucaggaagcggcuccugcccagagcgacguugcccuccugcgguuugucaaucccgauacaggcagagugcuuuucgaguguaagcugcacaaauccggguacgugaccgucgcucauacgggacagcacgaccucgugauuccgccuaacggcuauuuucgcuucgauucuuggguuaaccaauucuacacccuggcccccauggggaauggcacaggacggagacgcgcucuuuga

SEQ ID NO: 26651 - RNA, 1593 nt, Artificial Sequence; identical to SEQ ID NO: 26623
  derived and/or modified sequence opt5 from capsid_protein_VP1__Norovirus__AGT17836

SEQ ID NO: 26652 - RNA, 1620 nt, Artificial Sequence
  derived and/or modified sequence opt5 from capsid_protein_VP1__Norovirus__AGT17842
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccggccaggugacaauguucccgcauaucauugucgacgugagacaacucgagccugugcugaucccccugccugauguccggaacaauuuuuaucacuacaaccagucuaaugaccccaccauuaagcucguugcuaugcuguauacaccccuucgcgccaacaacgcuggggaugacguguucaccgugagcugcagaguccugacacggccuuccccggauuuugacuucaucuuucucgugcccccuaccauugaaagcaaaacgaagucuuucuccguucccauccugaccauugaggaaaugacaaauagccgcuuuccuaucccccuugagaaacuguucaccggaccgucuuccacacucgugguccagccucagaacggcagauguaccacggauggggugcugcugggaacaacccaacucagccccguuaauaucugcacauuccggggcgacgugacccagauuaccaacacacauucuuacgagaugaaucuggccgcccagaacuggaacuccuaugauccuacggaagagauccccgcuccucuuggcacccccgacuuugucgggaagauucagggagugcugacacaaaccacaaaggaaaauggcagcacccgcgcgcacaaagccacggucuacacaggguccaccggauucaccccgaagcucggcagagugcaguuuguuacagacaccgaucgggaccuggagacaaaucaggauacgaaauucaccccugugggggucauccaagacggagaugcucaucagaacgaaccccagcagugggugcuucccucuuaccugggcacaaauaaccacaauguucaccucgccccugccguggcuccgaccuuucccggcgagcaacugcuguucuuucgcagcacaaugccuggguguuccggauaucccaacaugaaucucgacugccugcuuccucaggaguggguccaguacuucuaucaggaagccgcgcccgcucaaagcgauguggcccugcucagauuugugaacccugacaccggccggguucuguucgaguguaaacuucauaagucuggguacgucacgguggcccacaccggacgccaugaucuggugauucccccgaacggcuauuuuagauucgacuccugggucagcccuuuuuacacacucgcucccauggggaauggcaccggacggagacgcgcccuguga

SEQ ID NO: 26653 - RNA, 1623 nt, Artificial Sequence
  derived and/or modified sequence opt5 from capsid_protein_VP1__Norovirus__AGU68328
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuugcggccgggaaaauuaucuucgcugccguuccucccaauuuuccuacagagggacugucccccucucaggugacgauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgccggcgaugacguuuucaccgugagcugcagagugcugacacggcccucuccugauuuugacuucauuuuucucgucccgcccaccguggaaucccgcacaaaaccuuucagcguucccgugcugaccgucgaggaaaugaccaauucuagauuuccuaucccccuugagaagcuguucacggggccguccagcgcuuucgugguucagccucagaacggacgguguacaaccgauggcgugcuccuggggacaacccaacugucucccgucaauauuugcacgcuccgcggagacgugacacauaucaccggcuccagaaacuacacaaugaaucuggcgagccagaacuggaauaacuaugauccuaccgaggaaauccccgccccucuuggcacccccgacuuugucgggaaaauucagggaaugcugacacagacgacccggacagacggcuccacccgcggguacaaggcuacaguguacaccggaucugccgauuucgccccgaagcucggcagaguucaauuugagacggacacagaucacgacuucgaagcuaaucagaacaccaaauuuaccccugugggggucauccaggauggaagcacaacccaucggaaugagccccaacagugggugcugcccuccuauagcggccgcaacacacacaauguucaccuugccccugcgguggcuccgacguuccccggcgaacagcugcucuuuuucagaucuaccaugccuggguguuccggauaccccaacauggaccuggauugccugcucccucaggaguggguccaauauuuuuaccaggaggccgcccccgcucagagcgacguggcccugcuucgguucgugaauccugauacaggcagaguucuguuugaauguaagcuccauaaaucuggguaugucaccguggcucacacaggacagcaugaccuggugauucccccgaacggcuacuuccgcuuugauagcugggucaaccaauucuauacccuugccccuauggggaauggcacgggacggagacgcgugguuuga

SEQ ID NO: 26654 - RNA, 1620 nt, Artificial Sequence
  derived and/or modified sequence opt5 from capsid_protein_VP1__Norovirus__AGX85889
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagagauucuguggucugccccucuuggcccggaucugaaccccuaccucagccaccugucccgcauguauaauggguacgcuggaggcuucgaagugcaggucauccuugccggcaacgcuuuugccgcggggaaaauuaucuucgccgcugugccucccaauuuuccuacggagggacugucucccagccagguuaccauguucccgcaucucaucguggacgucagacaacuggagccugugaugauuccccugccugauauccggaacaauuuuuaucacuacaaccaguccaaugaccccacaauuaagcucaucgccaugcuguauacaccccuucgcgcuaacaacgugggcgaugacgucuucaccguuagcugcagagugcugacccggccuucuccggauuuugacuucauuuuucucgugcccccuacagucgaauccaaaaccaaucccuucagcgugccuauccugacgauugaggaaaugaccaacucucgcuuucccaucccgcuugagaagcuguucacagggccuuccagcgcccucguugugcagccccagaauggaagauguaccacagauggcguccugcuggggaccacgcaacucucuccugugaacaucugcacauuccggggagacguuacccauacaaccaaaacccacacauaccagaugaaucuggccgcucagaacuggaacuccuaugaucccacggaggaaauuccugcgccccuuggcaccccggacuuugugggcaagauccaggggguccugacacaaaccacaaagggaaauggcagcacccgcgcccauaaagcuacgguguacacaggguccgccgaguucaccccuaagcucggacggauucagcuguuuaccgacacagauaaugaccuugaagccaaccagaauaccaaauucacacccgucggcgugauccaagauggggacacgcaccagaacgagccccagcaguggguucugccuucuuacagcggaagaaauaaccacaaugugcaucucgcuccggccgucgcgcccaccuuuccuggcgaacaacugcuguucuuucgcuccacaaugcccggcuguagcggguauccuaacaugaaccucgauugccugcuuccccaggagugggugcaguacuucuaucaggaggcugccccugcccaaucugacguugcucugcucagauuugugaaucccgauaccggacggguccuguucgaauguaaacuucacaaguccggcuacgugacaguggcccauaccgggcaccacgaccuguuuauuccgccuaacggauauuuccgcuuugauagcuggguuucucccuucuacacgcucgcuccuaugggcaaugggaccggcagacggagagcccuguga

SEQ ID NO: 26655 - RNA, 1620 nt, Artificial Sequence
  derived and/or modified sequence opt5 from capsid_protein_VP1__Norovirus__AGX85892
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuccuacggagggacugucccccucucaggugaccauguucccgcaucucaucgucgacgugagacaacuggagccugugaugaucccccugccugauauucggaacaauuuuuaucacuacaaccagagcaaugaccccacaaucaagcucauugcuaugcuguauacaccccuucgcgccaacaacgucggcgaugacguuuucaccguguccugcagagugcugacccggccuagcccggauuuugacuucaucuuucucgugcccccuacagucgaaucuaaaaccaaucccuucuccguuccuauucugacgaucgaggaaaugaccaacagccgcuuucccauuccgcuugagaagcuguucacagggccuucuuccgcccucgugguccagccccagaauggaagauguaccacagauggcgugcugcuggggaccacgcaacucagcccuguuaacaucugcacauuccggggagacgugacccauacaaccaaaacccacacauaccagaugaaucuggcugcgcagaacuggaacucuuaugaucccacggaggaaaucccugcuccccuuggcaccccggacuuugucggcaagauucagggggugcugacacaaaccacaaagggaaauggcuccacccgcgcccauaaagccacggucuacacagggggaguggaguucaccccuaagcucggcagaauccagcuguuuaccgacacagauaaugaccuugaagccaaccagaauaccaaauucacacccguuggggugauucaagauggagacacgcaccagaacgagccccagcaguggguccugccuagcuacuccggccggaauaaccacaaugugcaucucgcuccggccguugcgcccaccuuuccuggcgaacaacugcuguucuuucgcucuacaaugcccggguguagcggauauccuaacaugaaccucgauugccugcuuccccaggagugggugcaguacuucuaucaggaggcugccccugcccaauccgacgucgcucugcucagauuugugaaucccgauaccggccgggugcuguucgaauguaaacuucacaagagcggguacguuacagucgcccauaccggacaccacgaccuguuuaucccgccuaacggcuauuuccgcuuugauucuugggugucccccuucuacacgcucgcuccuauggggaauggcaccggaagacggagagcccuguga

SEQ ID NO: 26656 - RNA, 1620 nt, Artificial Sequence
  derived and/or modified sequence opt5 from capsid_protein_VP1__Norovirus__AGX85895
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucauugacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuccuacggagggacugucccccucucaggugaccauguucccgcaucucaucaucgacgucagacaacuggagccugugaugauuccccugccugaugugcggaacaauuuuuaucacuacaaccagagcaaugaccccacaaucaagcucauugcuaugcuguauacaccccuucgcgccaacaacgucggcgaugacguuuucaccguguccugcagagugcugacccggccuagcccggauuuugacuucaucuuucucgugcccccuacagucgaaucuaaaaccaaucccuucuccguuccuauucugacgaucgaggaaaugaccaacagccgcuuucccauuccgcuugagaagcuguucacagggccuucuuccgcccucgugguccagccccagaauggaagauguaccacagauggcgugcugcuggggaccacgcaacucagcccuguuaacaucugcacauuccggggagacgugacccauaucacaaaaacccacucuuaccagaugaaucuggcugcgcagaacuggaacuccuaugaucccaccgaggaaauuccugcuccccuuggcacaccggacuuugucggcaagauccagggggugcugacgcaaaccacaaagggaaauggcagcacccgcgcccauaaagccacagucuacaccggguccacggaguucacaccuaagcucggacggauucagcuggugaccgacaccgauaaugaccuugaaacaaaccagaauaccaaauuuacacccguuggcgugauccaagauggggacacgcaccagaacgagccccagcaguggguccugccuucuuaccucggaagaaauaaccacaaugugcaucuggccccggcuguugcccccaccuucccuggcgaacaacugcucuuuuuccgcagcacaaugcccggcuguuccggguauccuaacaugaaccuggauugccuucugccccaggagugggugcaguacuuuuaucaggaggcggcuccugcccaaagcgacgucgcccuccugagauucgugaaucccgauaccggacgggugcuuuuugaauguaagcugcacaaaucuggcuacguuacagucgcucauaccgggcaccacgaccucuucauuccgccuaacggauauuuucgcuucgauuccugggugagccccuuuuacacgcuggccccuaugggcaaugggaccggcagacggagagcucuguga

SEQ ID NO: 26657 - RNA, 1623 nt, Artificial Sequence
  derived and/or modified sequence opt5 from capsid_protein_VP1__Norovirus__AGX85904
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucacgguucccauccugaccguggaggaaaugacaaacucuagauuuccuauuccccuugagaagcuguucaccgggccguccagcgccuucgucgugcagccucagaauggacgguguacaaccgauggcguucuccuggggacgacacaacugucucccgugaacaucugcaccuuucgcggagacgucacacauaucgcuggcuccagaaauuacaccaugaaccucgcgagccugaauugguccaacuaugauccuaccgaggaaauucccgccccucuuggcacacccgacuucguggggaaaauccagggaguccugacgcagaccacaaagggcgacgggucuacccggggacacaaggcuacaguguacaccggcagcgccgauuuuacgccgaaacucggguccauucaguucgccacagacaccgagaaugauuuugaaacccaucaaaacacacgcuucaccccuguuggagugauccaggacggcggcacaacgcacagaaaugagccccagcaauggguccugcccagcuacucugggcggaacgugcacaauguucaucuugcuccugccguggcgccgaacuuucccggagaacagcuccuguucuuucgcuccaccaugccuggcuguagcggguaucccaauauggaucuggacugccugcucccucaggaguggguccagcacuucuaccaagaggcugcccccgcccagucugauguggcucugcuuagauuugugaacccugacacaggacggguucuguucgaauguaagcuccauaaaagcggcuaugucaccguggcccacacagggcagcacgaucuggugauucccccgaauggcuacuuuagauucgacuccugggucaaccaguucuauacccuugcuccuaugggaaacggcacggggcgccggagagcccuguga

SEQ ID NO: 26658 - RNA, 1617 nt, Artificial Sequence
  derived and/or modified sequence opt5 from capsid_protein_VP1__Norovirus__AGX85913
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucaucgacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuuccacggagggacugucuccuagccaggugaccauguucccccaucucaucgucgacgugagacaacuggagccggugaugaucccucugcccgauauucggaacaauuuuuaucacuacaaccaguccaaugacccuacaaucaagcucauugcuaugcuguauacaccccuucgcgccaacaacgucggcgaugacguuuucaccgugagcugcagagugcugacccggcccucuccugauuuugacuucaucuuucucgucccgcccacaguggaauccaaaaccaauccuuucagcguucccauucugacgaucgaggaaaugaccaacucucgcuuuccuauuccccuugagaagcuguucacagggccguccagcgcccucgugguccagccucagaauggaagauguaccacagauggcgugcugcuggggaccacgcaacucucucccguuaacaucugcacauuccggggagacgugacccauacaaccaaaacccacacauaccagaugaaucuggcugcgcagaacuggaacuccuaugauccuacggaggaaauccccgccccucuuggcacccccgacuuugucggcaagauucagggggugcugacacaaaccacaaaggagaauggaagcacccgcgcucauaaagccacggucuacacaggcaccguggaguucaccccgaagcucgggagaauccagcuguuuacagacaccgauaaugaccuugaagccaaccagaauacaaaauucacgccuguuggagugauucaagauggcgaccaccagaacgaaccccagcaguggguccugcccuccuacucugggcggaauaaccacaaugugcaucucgcuccugccguugcgccgaccuuucccggagagcaacugcuguucuuucgcagcacaaugccuggcuguuccggcuaucccaacaugaaccucgauugccugcuuccucaggagugggugcaguacuucuaucaggaagcugcccccgcccaaagcgacgucgcucugcucagauuugugaauccugauaccgggcgggugcuguucgaguguaaacuucacaagucuggauacguuacagucgcccauaccggccaccacgaccuggugauucccccgaacggguauuuucgcuucgauuccugggugagcccuuuuuacacgcucgcucccaugggaaauggcaccgggagacggagagcccuguga

SEQ ID NO: 26659 - RNA, 1623 nt, Artificial Sequence
  derived and/or modified sequence opt5 from capsid_protein_VP1__Norovirus__AGX85916
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucaccggcucuagaaauuacaccaugaaccucgccucccagaauuggaacagcuaugauccuacagaggaaauucccgcuccucugggcacgcccgacuucguggggaaaauccagggaguccuuacccagacaacccggacagacggcuccacccgcgggcacaaggcgacgguguacacaggaucugccgauuuuagcccgaagcugggcagaguucaauucgcuaccgacaccgauaaugacuuugauacaaaccagaauaccaaauucacaccugugggggucauucaggacggaggcacgacccaucggaacgagccccaacagugggugcuccccuccuacagcggccgcaauacacacaacguucaccuggccccugccguggcuccgaccuuucccggggaacagcuucuguucuuuagaucuacaaugccuggauccagcggcuaucccaauauggaucucgacugucugcugccucaggaguggguccaauacuucuaucaggaagccgcgcccgcucagucugauguggcccuccugcgguuugugaacccugacaccgggagaguucuuuucgagugcaagcugcauaaaagcggauacgucacgguggcccacaccggccagcaugaucucgugauucccccgaacggguauuuucgcuucgacuccugggucaaucaauucuacacacuggcuccuaugggcaacggaaccggccggagacgcgccguguga

SEQ ID NO: 26660 - RNA, 1617 nt, Artificial Sequence; identical to SEQ ID NO: 26658
  derived and/or modified sequence opt5 from capsid_protein_VP1__Norovirus__AGX85931

SEQ ID NO: 26661 - RNA, 1617 nt, Artificial Sequence
  derived and/or modified sequence opt5 from capsid_protein_VP1__Norovirus__AGX85934
augaagauggccagcuccgacgcuaaccccucugauggcagcaccgccaaucuggugccugaggcgaacaaugaagucauggcucucgagccgguugugggggccgccaucgcugcccccguggcuggacagcaaaacgucaucgacccuuggaucagaaauaacuucgugcaggcccccggcggggaauuuacaguuuccccucggaaugcgcccggagaggugcuguggucugccccucuuggcccggaucugaaccccuaccucagccaccuggcucgcauguauaauggguacgccggaggcuucgaaguccaggugauucuugcuggcaacgccuuugcggccgggaaaaucauuuucgcugccguuccucccaauuuuuccacggagggacugucuccuagccaggugaccauguucccccaucucaucgucgacgugagacaacuggagccggugaugaucccucugcccgauauucggaacaauuuuuaucacuacaaccaguccaaugacccuacaaucaagcucauugcuaugcuguauacaccccuucgcgccaacaacgucggcgaugacguuuucaccgugagcugcagagugcugacccggcccucuccugauuuugacuucaucuuucucgucccgcccacaguggaauccaaaaccaauccuuucagcguucccauucugacgaucgaggaaaugaccaacucucgcuuuccuauuccccuugagaagcuguucacagggccguccagcgcccucgugguccagccucagaauggaagauguaccacagauggcgugcugcuggggaccacgcaacucucucccguuaacaucugcacauuccggggagacgugacccauacaaccaaaacccacacauaccagaugaaucuggcugcgcagaacuggaacuccuaugauccuacggaggaaauccccgccccucuuggcacccccgacuuugucggcaagauucagggggugcugacacaaaccacaaagggaaauggcagcacccgcgcucauaaagccacggucuacacagggaccguggaguucaccccgaagcucggaagaauccagcuguuuacagacaccgauaaugaccuugaagccaaccagaauacaaaauucacgccuguuggcgugauucaagauggggaccaccagaacgagccccagcaguggguccugcccuccuacucuggacggaauaaccacaaugugcaucucgcuccugccguugcgccgaccuuucccggcgaacaacugcuguucuuucgcagcacaaugccuggcuguuccggguaucccaacaugaaccucgauugccugcuuccucaggagugggugcaguacuucuaucaggaggcugcccccgcccaaagcgacgucgcucugcucagauuugugaauccugauaccggacgggugcuguucgaauguaaacuucacaagucuggcuacguuacagucgcccauaccgggcaccacgaccuggugauucccccgaacggauauuuucgcuucgauuccugggugagcccuuuuuacacgcucgcucccaugggcaaugggaccggcagacggagagcccuguga

SEQ ID NO: 26662 - RNA, 1644 nt, Artificial Sequence
  derived and/or modified sequence opt5 from capsid_protein_VP1__Norovirus__AHI59154
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaagggacgguguucggagucgcuucucagagagacguguccggccagcagguuggggccacccgggcccacgaagugcacaucaacacaaccgaucccagauauacaccgaagcugggaagcauucugaugcauuccgagucugacgauuuugucaccggccaaccugugcgcuucacgcccaucgggaugggagacaaugauuggcaccagugggagcuccccgacuacagcggccaucugacacuuaacaugaaucuggcuccugccguugcgccggcuuuucccggcgaacggauucucuucuuuagauccauggugccuagcgccgggggauacggcucugggcagaucgauugccugaugccccaggaguggguccaacacuucuaucaggaagccgcuccuucccagagcgccguggcucuuauucgcuacgugaaccccgacaccggacggaauaucuuugaggccaagcugcacagagaaggcuucaucaccguugcgaacucugggaauaacccuauugucgugcccccgaauggcuauuuucgcuucgaggccugggugaaccaguuuuacacacucaccccuaugggaacaggccaagggcggagacgcaaucaguga

SEQ ID NO: 26663 - RNA, 1623 nt, Artificial Sequence
  derived and/or modified sequence opt5 from capsid_protein_VP1__Norovirus__AHI59157
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggacgguguacaaccgauggcgugcuccuggggacgacacaacuguccccugucaacauuugcaccuuucgcggagacgugacacauaucaccggcagcagaaauuacaccaugaaccucgccucucagaauuggaacuccuaugaucccacagaggaaaucccugcuccccugggcacgccggacuucgucgggaaaauucagggagugcuuacccagacaacccggacagacggcagcacccgcgggcacaaggcgacgguuuacacaggauccgccgauuuuucuccuaagcugggcagagugcaauucgcuaccgacaccgauaaugacuuugagacaaaccagaauaccaaauucacacccgucggggugauccaggauggaggcacgacccaucggaacgaaccccaacaguggguucucccuagcuacuccggccgcaauacacacaacgugcaccuggccccggccgucgcucccaccuuuccuggggagcagcuucuguucuuuagaagcacaaugcccggauguucuggcuauccuaauauggaccucgauugccugcugccccaggaaugggugcaauacuucuaucaggaggccgcgccugcucaguccgacguggcccuccugcgguuuguuaaccccgauaccgggagaguccuuuucgaguguaagcugcauaaaagcggauacgugacgguggcccacaccggccagcaugaccucgucauuccgccuaacggguauuuucgcuucgauucuugggugaaucaauucuacacacuggcucccaugggcaacggaaccggccggagacgcgcccuuuga

SEQ ID NO: 26664 - RNA, 1629 nt, Artificial Sequence
  derived and/or modified sequence opt5 from capsid_protein_VP1__Norovirus__AHI59159
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgaauuucgugcaagcccccaacggggaauuuaccgucuccccucggaaugcucccggagaggugcuucugaaccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcagcccguucgacccuucugaagauguccccgcgccucucggggugcccgacuuccagggacgcgucuuuggcgugauuucccaaagagauaagcacaauagcccugggcauaacgagcccgccaaucggggacacgacgcuguugugccgacauacacggcccaguacaccccuaaacugggccagguccaaaucgggacauggcagaccgaugaccugacagugaaccagcccguuaaguucacccccgugggacucaaugauacggaacauuuuaaccagugggucgugccucgcuaugccggcgcucugaaucuuaacacaaaucuggccccguccguggcgcccguuuucccuggcgagagacuccuguuuuuccggucuuacgucccccuuaaagggggauauggcaacccugcuauugacugccugcucccccaagagugggugcagcacuuuuaccaggaagccgccccuagcauguccgagguggcucugguccgcuauaucaaucccgauaccgggagagcccuguucgaagcuaagcuccaccgggccggauuuaugaccgugagcucuaacacauccgcgccgguuguggucccugccaacggcuacuucagauuugacagcugggugaaucaguucuauucucuggcucccauggggaccggcaacggacgccggagaguucaauga

SEQ ID NO: 26665 - RNA, 1623 nt, Artificial Sequence
  derived and/or modified sequence opt5 from capsid_protein_VP1__Norovirus__AHK24788
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacagcugcccagaucaccuguuucccccaugugaugugcgacguccgcacacuggaaccgauccaacuuccucugcucgaugugagacgggugcuguggcacgcuacccaggaccaggaggagucuaugcgccuugucuguaugcuguauacaccccucagaaccaauagcccuggggaugaauccuuuguugugagcggacggcugcugucuaaacccgccgccgacuucaacuuuguguaccucacgcccccuauugagcgcaccaucuauagaauggucgaucugccggugcuucagccccggcugugcacacaugcucgcuggccugcgcccguuuacggccuccugguggacccuucccuucccagcaauccgcaauggcagaacgggagaguccacguggauggaacccugcucggcacaaccccuguuucuggcuccugggugagcuguuucgccgcugaagccgccuaugaguuucagucugggacgggagaggucgcuacauucacccugauugaacaagacggcuccgccuacgugcccggggaucgggcggcuccucugggauaccccgacuuuagcggccagcucgagaucgaaguccagacagagaccaccaaggccggggacaaacugaaggugacaacguucgaaaugauucuuggaccuaccacaaauguugaucaggcccccuaucaaggccgcguguacgcuucccugaccgccgcugccucucucgaccuggucgauggcagagugcgggcgguuccgcgcagcaucuauggguuccaggaccagauuccugaguacaacgauggacuucuggugccccucgcucccccugucggcccguuucugcccggggagcugcuccugagauuccggacauauaugagacagaucgacuccgccgaugccgcugccgaagcgaucgacugcgcccuuccucaagaguuuauuagcugguucgcuucuaaugccuuuaccgugcaguccgaagcucugcuccugcgcuaccggaacacgcugacaggacagcuucucuucgaguguaagcuguauagcgaaggcuacaucgcccugucuuacagcggguccggcccccucaccuuuccuaccgauggauucuuugaggugguuucuuggguccccagacuguaucagcuugccagcgugggcucccuggcuacagggcgcacccucaaauga

SEQ ID NO: 26666 - RNA, 1623 nt, Artificial Sequence
  derived and/or modified sequence opt5 from capsid_protein_VP1__Norovirus__AHX22018
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuggagccuucgugguccagccccagaacggccgguguaccacagauggggugcuccugggaaccacgcaacuguccccugucaauauuugcacauuucgcggcgacgugacccauaucacaggcagcagaaacuacaccaugaaucucgcuucucagaacuggaauaacuaugaucccaccgaggaaauuccugcgccccuggggacaccggacuucguuggaaaaauccagggcaugcuuacgcagaccacacggaccgacggguccacacgcggacacaaggccaccguguacacgggcagcgcugauuuugccccuaagcuggggagaguccaauucgagacagacaccgaucaugacuuugaagccaaucagaacaccaaauucacacccgugggaguuauccaggauggcuccaccacacaccggaaugagccccaacagugggugcucccuucuuacagcggccgcaacacgcacaauguccaucuggcuccggccguggcgcccaccuuuccuggggaacagcuucuguucuuuagauccacaaugcccggauguagcggcuauccuaacauggaccucgauugccugcugccccaggagugggugcaauacuucuaucaggaggcugccccugcccagucugacguugcucuccugcgguuugucaaucccgauaccgggagagugcuuuucgaauguaagcugcacaaauccggauacgugacagucgcccauaccggccagcacgaccucgugauuccgccuaacggguauuuucgcuucgauagcuggguuaaccaauucuacacgcuggcucccaugggcaauggaaccggccggagacgcguggucuga

SEQ ID NO: 26667 - RNA, 1623 nt, Artificial Sequence
  derived and/or modified sequence opt5 from capsid_protein_VP1__Norovirus__AHX22021
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucacaaccgacaccgauaaugacuuugucacaaaucagaacaccaaauucacacccguggggguuauccaggauggaagcacgacaccccggaaugagccucaacagugggugcucccgucuuacuccggccgcaacacccauaauguccaccuggcucccgccguggccccuaccuuucccggcgaacagcuucuguucuuuagaagcacaaugccuggguguucuggauaucccaacauggaccucgauugccugcugccucaggagugggugcaauacuucuaucaggaagcugcccccgcgcagagcgacguugcucuccugcgguuugucaauccggauaccggcagagugcuuuucgaguguaagcugcacaaauccggguacgugacggucgcccauaccggacagcacgaccucgugauuccucccaacggcuauuuucgcuucgauucuuggguuaaccaauucuacacacuggccccuauggggaauggcaccggacggagacgcgcucuuuga

SEQ ID NO: 26668 - RNA, 1623 nt, Artificial Sequence
  derived and/or modified sequence opt5 from capsid_protein_VP1__Norovirus__AHX22025
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccagacgauccuugccggcaacgcuuuuaccgccgggaaaauuaucuucgcggccgugccucccaauuuuccuacagagggacugucccccucucagguuaccauguucccgcauaucauuguggacgucagacaacucgagccugugcugaucccccugccugaugugcggaacaauuuuuaucacuacaaccagacaaaugaccccaccauuaagcucaucgcuaugcuguauacaccccuucgcgccaacaacgcuggcgaugacgucuucaccguuagcugcagagugcugacgcggccuuccccggauuuugacuucauuuuucucgugcccccuaccgucgaaagccgcacaaaacccuucucugugccuguucugaccguggaggaaaugacaaauuccagauuucccaucccgcuugagaagcuguucaccgggccuagcucugccuucgucgugcagccccagaacggacgguguacgacagauggcguucuccuggggaccacacaacuguccccugugaauauuugcaccuuucgcggagacgucacccauaucagcggcucuagaaacuacacaaugaaucucgccucccagaacuggaauagcuaugaucccacggaggaaaucccugcuccccugggcaccccggacuucguggggaaaauucagggaguccuuacacagaccacacggaccgacggcuccacgcgcgggcacaaggcgacaguguacaccggaucugccgauuuuagcccuaagcugggcagaguucaauucgcuaccgacacagauaacgacuuugagaccaaucagaacacaaaauucacgcccgugggggucauccaggauggaggcaccacacaucggaaugaaccccaacagugggugcucccuuccuacagcggccgcaacacccacaauguucaccuggccccggccguggcucccacauuuccuggggagcagcuucuguucuuuagaucuaccaugcccggauguuccggcuauccuaacauggaccucgauugccugcugccccaggaauggguccaauacuucuaucaggaggccgcgccugcucagagcgacguggcccuccugcgguuugugaaucccgauacggggagaguucuuuucgaguguaagcugcauaaaucuggauacgucaccguggcccacacaggccagcaugaccucgugauuccgccuaacggguauuuucgcuucgauagcugggucaaccaauucuacacccuggcucccaugggcaauggaacaggccggagacgcgcccuuuga

SEQ ID NO: 26669 - RNA, 1623 nt, Artificial Sequence
  derived and/or modified sequence opt5 from capsid_protein_VP1__Norovirus__AHX22028
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccagcacgaccucguuauuccgccuaacggguauuuucgcuucgauagcugggugaaccaauucuacacgcuggcucccaugggcaauggaaccggccggagacgcgucguguga

SEQ ID NO: 26670 - RNA, 1623 nt, Artificial Sequence
  derived and/or modified sequence opt5 from capsid_protein_VP1__Norovirus__AHX22032
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccagacgauccuugccggcaacgcuuuuaccgccgggaaaauuaucuucgcggccgugccucccaauuuuccuacagagggacugucccccucucagguuaccauguucccgcauaucauuguggacgucagacaacucgagccugugcugaucccccugccugaugugcggaacaauuuuuaucacuacaaccagacaaaugaccccaccauuaagcucaucgcuaugcuguauacaccccuucgcgccaacaacgcuggcgaugacgucuucaccguuagcugcagagugcugacgcggccuuccccggauuuugacuucauuuuucucgugcccccuaccgucgaaagccgcacaaaacccuucucugugccuguucugaccguggaggaaaugacaaauuccagauuucccaucccgcuugagaagcuguucaccgggccuagcucugccuucgucgugcagccccagaacggacgguguacgacagauggcguucuccuggggaccacacaacuguccccugugaauauuugcaccuuucgcggagacgucacccauaucagcggcucuagaaacuacacaaugaaucucgccucccagaacuggaauagcuaugaucccacggaggaaaucccugcuccccugggcaccccggacuucguggggaaaauucagggaguccuuacacagaccacacggaccgacggcuccacgcgcgggcacaaggcgacaguguacaccggaucugccgauuuuagcccuaagcugggcagaguucaauucgcuaccgacacagauaacgacuuugagaccaaucagaacacaaaauucacgcccgugggggucauccaggauggaggcaccacacaucaaaaugaaccccagcagugggugcucccuuccuacagcggccgggacacccacaacguucaccuggccccggccguggcucccacauuuccuggggagcagcuucuguucuuucgcucuaccaugcccggauguuccggcuauccuaauauggaucucgacugccugcugccccaagaauggguccaguacuucuaucaggaggccgcgccugcucagagcgauguggcccuccugagauuugugaaccccgacacggggcggguucuuuucgaguguaagcugcauaaaucuggauacgucaccguggcccacacaggccaacaugaucucgugauuccgccuaauggguauuuuagauucgacagcugggucaaccaguucuacacccuggcucccaugggcaacggaacaggccgccggagagcccuuuga

SEQ ID NO: 26671 - RNA, 1623 nt, Artificial Sequence
  derived and/or modified sequence opt5 from capsid_protein_VP1__Norovirus__AHX22038
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccugaacuggaauaacuaugaucccaccgaggaaauuccugcgccccuuggcacaccggacuucguugggaaaauccagggaaugcugacgcagaccacacggaccgacggcagcacacgcgggcacaaggccaccguguacacgggauccgcugauuuugccccuaagcucggcagaguccaguucgagacagacaccgaucaugacuuugaagccaaucaaaacaccaaauucacacccguggggguuauccaggauggaucuaccacacaccggaaugagccccagcaaugggugcugccuagcuacuccggccgcaacacgcacaauguccaucuugcuccggccguggcgcccaccuuuccuggcgaacagcuccuguucuuuagaagcacaaugcccggguguucuggauauccuaacauggaccuggauugccugcucccccaggagugggugcaguacuucuaucaagaggcugccccugcccaguccgacguugcucugcuucgguuugucaaucccgauaccggcagagugcuguucgaauguaagcuccacaaaagcggguacgugacagucgcccauaccggacagcacgaccuggugauuccgccuaacggcuauuuucgcuucgauucuuggguuaaccaguucuacacgcuugcucccauggggaauggcaccggacggagacgcguggucuga

SEQ ID NO: 26672 - RNA, 1623 nt, Artificial Sequence
  derived and/or modified sequence opt5 from capsid_protein_VP1__Norovirus__AHX22041
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgccacagacaccgaucacgacuuugaggcuaaucagaacaccaaauucacacccguuggggugauccaggauggaggcaccacacacagaaaugaaccccaacaguggguccucccuucuuacagcggccggaacacgcauaaugugcaccuggccccggcgguggcucccaccuuuccuggggagcagcuucuguucuuucgcuccacaaugcccggauguagcggcuauccuaacauggaccucgauugccugcugccccaggaauggguucaauacuucuaucaggaggccgccccugcucagucugacgucgcccuccugagauuugugaaucccgauaccgggcgggugcuuuucgaguguaagcugcauaaauccggauacgucacaguggcucacaccggccagcacgaccucguuauuccgccuaacggguauuuuagauucgauagcugggugaaccaauucuacacgcuggcccccaugggcaauggaaccggccgccggagagucguguga

SEQ ID NO: 26673 - RNA, 1623 nt, Artificial Sequence
  derived and/or modified sequence opt5 from capsid_protein_VP1__Norovirus__AHX22047
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcuccgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauauccccggcuccagaaauuacaccaugaaccucgccagccagaauuggaacuccuaugauccuaccgaggaaauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaacgauuuugagaccaaucagaacacaaaauucacccccgucggggugauccaggacggaagcacaacgccucggaaugaaccgcaacaguggguucuccccucuuacuccggccgcaacauucauaaugugcaccuggccccugccgucgcucccaccuuuccuggcgagcagcuucuguucuuuagaagcacaaugcccggguguucuggauauccuaacauggaucucgacugccugcugccccaggaaugggugcaauacuucuaucaggaggccgcgccggcucagagcgauguggcccuccugcgguuuguuaauccugacaccggcagaguccuuuucgaguguaagcugcacaaauccggguacgugacaguggcccauaccggacagcacgaucucgucauucccccuaacggcuauuuucgcuucgacucuugggugaaccaauucuacacgcuggcucccauggggaauggcaccggacggagacgcgcccuuuga

SEQ ID NO: 26674 - RNA, 1623 nt, Artificial Sequence
  derived and/or modified sequence opt5 from capsid_protein_VP1__Norovirus__AHX22050
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaagcacaacgccccggaaugagccucaacagugggugcucccgucuuacuccggccgcaacacccauaauguccaccuggcccccgccguggcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguugcccuccugcgguuugucaauccggauacaggcagagugcuuuucgaguguaagcugcacaaauccggguacgugaccgucgcccauacgggacagcacgaccucgugauuccucccaacggcuauuuucgcuucgauucuuggguuaaccaauucuacacccuggcuccuauggggaauggcacaggacggagacgcgcccuuuga

SEQ ID NO: 26675 - RNA, 1623 nt, Artificial Sequence
  derived and/or modified sequence opt5 from capsid_protein_VP1__Norovirus__AHX22054
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugauccauaucuccggcagcagaaacuacacaaugaaucucgccucccagaacuggaacucuuaugauccuaccgaggaaauucccgcuccucugggcacccccgacuucgucgggaaaauccagggagugcuuacacagacgacccggacagacggcagcacccgcgggcacaaggcgacaguuuacaccggauccgccgauuuuagcccgaagcugggcagagugcaauucgcuacggacacagauaaugacuuugucaccaaucagaacaccaaauucacaccuguggggguuauucaggauggaucuaccacaccccggaaugagccccaacagugggugcucccuuccuacagcggccgcaacacgcauaauguccaccuggccccggccguggcucccaccuuuccuggcgaacagcuucuguucuuuagaucuacaaugcccggguguagcggauauccuaacauggaccucgauugccugcugccccaggagugggugcaauacuucuaucaggaagccgcgccugcucaguccgacguugcccuccugcgguuugucaaucccgauaccggcagagugcuuuucgaguguaagcugcacaaaucuggguacgugacagucgcccauaccggacagcacgaccucgugaucccgccuaacggcuauuuucgcuucgauagcuggguuaaccaauucuacacgcuggcucccauggggaauggcaccggacggagacgcgcccuuuga

SEQ ID NO: 26676 - RNA, 1647 nt, Artificial Sequence
  derived and/or modified sequence opt5 from capsid_protein_VP1__Norovirus__AIA96988
augaagauggccagcaacgacgcugcccccuccaaugauggcgcggcugggcuggugccugagaucucuaacgaagccauggcccucgacccggucgcuggagccgcuauugccgcgccccugaccggccagcaaaauaucauugauccuuggaucaugaacaauuucguucaggcccccgggggagaguuuacagugagcccuagaaacucccccggcgaaauucuucugaaucucgagcuggggccugaaaucaacccguaccuugcucaccuggcccggauguauaauggauacgcuggcggcuucgaggugcaggucgugcucgccgggaacgcguuuacggccggaaaaguuaucuucgcugccauucccccuaauuuucccaccgacaaccugucugcugcccagaucacaaugugcccucaugugauugucgaugugcgccaacuggagcccaucaaucucccgaugccugacguuagaaacaauuucuuucacuauaaccagggcagcgauucccggcugcgccuuauugccaugcuguacacaccccucagagcuaacaauucuggggacgauguguucaccgucagcugucgggugcugacccgcccuucccccgacuuuagcuucaacuuucuugugcccccuacagucgaaucuaagaccaaaccguucacgcugcccauccucaccauuuccgagaugagcaauucuagauuuccuguucccaucgauucccugcauacaagcccuaccgacaacaucguggugcagugccagaauggacgggucacacuggauggcgaacucauggggaccacgcaacugcuucccucucagauuugugcguuccgcggagugcugacaagauccaccagccgggccuccgaccacgcugacacagccaccccgcgccucuucaacuauuacuggcauauccagcuggauaaucuuaacggcaccccuuaugaccccgccgaggauauuccugcuccccugggcacaccugacuuuagagggaagguuuucggaguggccucucagcggaaucccgauagcacgacccgcgcgcacgaggcuaaagucgacacaaccuccggcagauuuacaccgaagcucgggagccuggaaaugucuaccgaguccgaugacuucgaucaaaaccagccuacgcgguuuacacccgugggaaucggcguugacaaugaagccgauuuccagcaauggacccugcccgacuacagcgggcaguuuacccacaacaugaaucucgccccugcuguggccccgaacuuccccggagagcagcugcuguuuuucagaucucagcuuccuagcuccggcggccgcucuaaugggauucucgacugccuggucccccaagaaugggugcagcauuuuuaccaggagagcgcuccugcccagacacaagucgcgcuugugcgguauguuaaccccgauaccggaagagugcuguucgaggccaagcuccacaaacugggcuacaugacaaucgcuaaguccggggacagcccuaucacggugcccccgaacggauauuuucgcuucgaaucuugggucaauccuuucuacacccuggcccccaugggcacagggaacggccggagacgcauucaguga

SEQ ID NO: 26677 - RNA, 1623 nt, Artificial Sequence
  derived and/or modified sequence opt5 from capsid_protein_VP1__Norovirus__AII02569
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguggcccugcuucgcuuuguuaaccccgauacaggcagaguccuguucgaguguaaacucuauaaguccggguacgugaccguggcucauacgggccagcacgaccuggucaucccgccuaauggauauuuucgguucgauagcugggugaaccaguucuacacccuugcccccaugggcaacgggacaggaagacgccgggcucuguga

SEQ ID NO: 26678 - RNA, 1623 nt, Artificial Sequence; identical to SEQ ID NO: 26475
  derived and/or modified sequence opt5 from capsid_protein_VP1__Norovirus__AII02572

SEQ ID NO: 26679 - RNA, 1623 nt, Artificial Sequence; identical to SEQ ID NO: 26475
  derived and/or modified sequence opt5 from capsid_protein_VP1__Norovirus__AII02575

SEQ ID NO: 26680 - RNA, 1623 nt, Artificial Sequence; identical to SEQ ID NO: 26518
  derived and/or modified sequence opt5 from capsid_protein_VP1__Norovirus__AII02578

SEQ ID NO: 26681 - RNA, 1647 nt, Artificial Sequence
  derived and/or modified sequence opt5 from capsid_protein_VP1__Norovirus__AII02581
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugcuccuggccgggaacgcguuuacggccggaaaaaucaucuucgcugccauucccccuaauuuucccaucgauaaccugucugcugcccagauuaccaugugcccucauguuaucguggacguccgccaacucgaacccgugaaucugccgaugccugauguuagaaacaauuucuuucacuauaaccagggcagcgacucccggcuucgccugauugccaugcucuacacaccccugagagcuaacaauucuggggaugacguguucaccgucagcugucgggugcuuacacgcccuucccccgauuuuagcuucaacuuucuggugcccccuaccgucgagucuaagacaaaaccguucucccuccccauccugaccauuagcgaaaugucuaauuccagauuuccuguucccaucgacagccugcauacgucuccuaccgagaacaucguggugcagugccagaauggacgggucacacucgauggcgagcugauggggaccacacaacuucugcccucccagauuugugcguuccgcggaaugcucaccagaagcacgucccgggccucugaccaggcugauacagccaccccgcgccuguucaacuauuacuggcacauccagcuugacaaucugaacggcacaccuuaugaccccgccgaagauauuccuggcccccucgggaccccugacuuuagaggaaagguguucggcguugcuagccaacggaaucccgaugccaccacacgcgcgcaugaggcuaaaaucgacacgaccuccgggagauuuacaccgaagcugggaagccuggaaauuucuaccgaguccggcgauuucgaccagaaccagccuacacgguuuacccccguggggaucggagucgaucacgaagccgacuuccaacaguggacgcuccccgauuacgccggccaguuuacacacaauaugaaccuggcuccugccguggcuccgaauuuccccggcgagcagcuucuguuuuucagaagccaacucccuucuagcgggggacgcuccaacggcauccuggacugccuuguuccccaggagugggugcagcauuuuuaccaggaaucugccccuagccaaacccaggucgcgcuggugcgguaugucaaucccgauaccgggagaguucucuucgaggccaagcugcacaaacugggauuuaugacaauugcuaaguccggcgacagcccuaucaccgugcccccgaacggguacuuccgcuucgaaucuugggugaacccuuuuuauacacucgcccccaugggcacgggaaauggccggagacgcauucaguga

SEQ ID NO: 26682 - RNA, 1623 nt, Artificial Sequence
  derived and/or modified sequence opt5 from capsid_protein_VP1__Norovirus__AII02584
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagacaaacgacucuaccauuaagcucaucgccaugcuguauacaccccuucgcgcuaacaaugccggcgaagauguuuucaccgugagcugcagagugcugacacggcccuccccugacuuugauuucauuuuucucgucccgcccaccguggagagccgcacgaaaccuuucaccguucccauccugacaguggaagagaugaccaacucuagauuuccuauuccccuugagaagcuguucacagggccguccagcgccuucgucgugcagccucagaauggacgguguaccacggacggcguucuccuggggacaacccaacugucucccgugaacaucugcacauuucgcggagaugucacccauaucgcuggcuccagaaauuacaccaugaaccucgcgagccugaauuggaacaauuaugacccuacagaagagauucccgccccucuuggcacgcccgauuucguggggaaaauccagggaguccugacccagacaaccaagggcgacgggucuacacggggacacaaggcuaccguguacacgggcuccgccccguuuacaccuaaacucgggagcguucaguucuccaccgacaccgaaaacgauuuugagacacaucaaaauaccaaguucacacccgugggagucauucaggacggcggcacgacccaccgcaacgaaccccagcaaugggugcugccuucuuacagcgggagaaauguucacaacgugcaucuugccccggcugucgcccccacauuuccuggagagcagcuccuguucuuucgguccaccaugcccggcuguagcggguauccuaauauggaucuggacugccugcucccccaggagugggugcagcacuucuaccaagaagcggcuccugcccagucugauguggcccugcuucgcuuuguuaaccccgacacaggaagaguccuguucgaguguaaacuccauaaguccggcuaugugaccguggcucacacggggcagcacgaucuggucaucccgccuaacggcuacuuucgguucgacagcugggugaaucaguucuauacccuugcccccaugggaaacggcacagggagacgccgggcucuguga

SEQ ID NO: 26683 - RNA, 1623 nt, Artificial Sequence; identical to SEQ ID NO: 26475
  derived and/or modified sequence opt5 from capsid_protein_VP1__Norovirus__AII02590

SEQ ID NO: 26684 - RNA, 1623 nt, Artificial Sequence; identical to SEQ ID NO: 26522
  derived and/or modified sequence opt5 from capsid_protein_VP1__Norovirus__AII02593

SEQ ID NO: 26685 - RNA, 1623 nt, Artificial Sequence; identical to SEQ ID NO: 26475
  derived and/or modified sequence opt5 from capsid_protein_VP1__Norovirus__AII02596

SEQ ID NO: 26686 - RNA, 1623 nt, Artificial Sequence
  derived and/or modified sequence opt5 from capsid_protein_VP1__Norovirus__AII02599
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgauaucacccauauugcuggcuccagagacuacaccaugaaccucgcgagccugaauuggaacaauuaugauccuacagaagagauccccgccccucuugggacgcccgacuucgucggaaaaauucagggcgugcugacccagacaaccaagcgggacgggucuacacgcggacacaaggcuaccgucuacacgggcuccgccccguuuacaccuaaacucgggagcgugagauucuccaccgauaccgaaaacgacuuugagacacaucagaauaccaaguucacacccguuggagugauccaagauggcucuacgacccaccggaacgaaccccagcaguggguccugccuagcuacuccggccgcgacgugcacaauguucaucuugccccggcuguggcccccacauuuccuggggagcaacuccuguucuuuagaagcaccaugcccggauguucuggcuauccuaacauggaucuggacugccugcucccccaggaguggguccagcacuucuaccaggaagcggcuccugcccaauccgauguggcccugcuucgguuugugaaucccgacacagggagaguucuguucgaguguaaacuccauaagagcggauaugucaccguggcucacacgggccagcacgaucuggugauuccgccuaacggguacuuucgcuucgacucuugggucaaucaguucuauacccuugcccccaugggcaacggaacaggccggagacgcgcucuguga

SEQ ID NO: 26687 - RNA, 1623 nt, Artificial Sequence; identical to SEQ ID NO: 26522
  derived and/or modified sequence opt5 from capsid_protein_VP1__Norovirus__AII02602

SEQ ID NO: 26688 - RNA, 1608 nt, Artificial Sequence
  derived and/or modified sequence opt5 from capsid_protein_VP1__Norovirus__AII02605
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgagaaucacguuuggaacaugcaagugaccaauauuaacgggacaccuuucgaucccaccgaagacgucccugcuccccugggaaccccggauuucagcggcaaacucuuuggggugcugucucagcgcgaccaugacaaugccuguagaucccacgaugccgucaucgcuacaaacagcgcgaaguucacgccuaaacuuggagccauucagaucggcaccugggagcaggacgaugugcacaucaaucagcccacaaaguuuacccccguugggcuguucgaguccgaaggauuuaaccaauggacacucccuaauuauucuggcgcucugacccuuaacaugggccuggccccgcccguggccccuacguuccccggggagcagauucucuuuuuccggagccauaucccucugaagggaggcgucgcugaccccgugauugauugccugcucccucaggaauggauccagcaccuguaccaagaguccgcccccagccagacagacguugcgcuuauucgcuuuaccaacccggauaccgggagagugcuguucgaagcuaaacuccaucggucuggauacaucacagucgccaauaccggcuccagaccuaucguggugcccgccaacggguauuuucgcuucgacagcuggguuaaucaguuuuacucucuggcuccuaugggcacaggaaacggccggagacgcguccaguga

SEQ ID NO: 26689 - RNA, 1647 nt, Artificial Sequence
  derived and/or modified sequence opt5 from capsid_protein_VP1__Norovirus__AII02608
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaaccguucucccugcccauccucaccauuagcgaaaugucuaauuccagauuuccugugcccaucgacagccugcauacgucuccuaccgagaacaucgugguccagugccagaauggacgggugacacuggauggcgagcucauggggaccacacaacugcuucccucccagauuugugcguuccgcggaaugcugaccagaagcacgucccgggccucugaccaggcugauacagccaccccgcgccucuucaacuauuacuggcacauccagcuggacaaucuuaacggcacaccuuaugaccccgccgaagauauuccuggcccccuggggaccccugacuuuagaggaaagguuuucggcguggcuagccaacggaaucccgaugccaccacacgcgcgcaugaggcuaaaaucgacacgaccuccgggagauuuacaccgaagcucggaagccuggaaauuucuaccgaguccggcgauuucgaccagaaccagccuacacgguuuacccccgucgggaucggaguggaucacgaagccgaccugcaacaguggacgcuccccgauuacgccggccaguucacacacaauaugaaccuggcuccugccguugcuccgaauuuucccggcgagcagcuucuguucuuuagaagccaacucccuucuagcgggggacgcuccaacggcauccuggacugccuugugccccaggaguggguccagcauuucuaccaggaaucugccccuagccaaacccagguggcgcugguccgguaugugaaucccgauaccgggagaguucucuuugaggccaagcugcacaaacugggauucaugacaauugcuaaguccggcgacagcccuaucaccgugcccccgaacggguacuuucgcuucgaaucuugggucaacccuuucuauacacucgcccccaugggcacgggaaauggccggagacgcauucaguga

SEQ ID NO: 26690 - RNA, 1623 nt, Artificial Sequence; identical to SEQ ID NO: 26529
  derived and/or modified sequence opt5 from capsid_protein_VP1__Norovirus__AII02614

SEQ ID NO: 26691 - RNA, 1653 nt, Artificial Sequence
  derived and/or modified sequence opt5 from capsid_protein_VP1__Norovirus__AII02623
augaagauggccagcaacgacgcuacccccuccaaugauggcgccgcgaaccuggugccugaagcuaauaacgaagucauggcccucgagccgguugugggggccucuaucgcugcccccguggucggacagcaaaauauuaucgacccuuggauuagagaaaacuucgugcaggcuccccagggcgaguuuacaguuagcccucgcaauucccccggggaaaugcugcuuaaccuggagcucggaccugagcugaauccguaccuuucucaccugagccggauguauaacggcuacgccgggggaaugcaagugcaggucgugcucgcgggcaaugccuucacggcuggcaagaucauuuuugccgcuguucccccucauuuccccguggauaacaucuccgccgcgcagaucaccaugugcccucacgucauuguggacgugagacagcuggaacccguccugcucccgcugccugauauccggaaucgcuuuuuccauuauaaccaggagaauacacccagaaugcggcuuguugccaugcuguacaccccucuccgcgcuaacucuggggaagacguguuuacagugagcuguagaguccugacccggcccgcccccgauuucgaguuuacauuccuugugccuccgaccguugaguccaagacgaaacccuuuacccugccuauucucacacugggagaacugagcaacucucgcuuccccgcugccaucgacaugcucuauaccgauccuaaugaguccauugugguccaaccccagaacggcagaugcacacuggacgggacccuucagggaacgacacagcuggugccgacccaaaucugugccuuucggggcacacucauuagccagaccgcucgcgcggccgauucuaccgacuucccucagagagcucggaaucacccccugcauguucaagugaagaaccuugaugggacacaguacgacccuacggacgauauccccgccguccugggagccaucgacuucaaaggcaccguguuuggcgucgcuucccagcgcgaugugagcgggacacaggaacaaggacacuaugccaccagagcgcacgaggcucauauugacacaaccgauccuaaguacgcccccaagcucggcacgauccugauuaaaucugaauccacagacuucaauaccaaccagccgauccgguuuaccccuguugggaugggagauaauaacuggagacagugggagcugcccgacuacagcggcucccucacacugaauaugaaccuugcccccgcugugucuccuagcuucccgggggagcgcauucuguuuuuccgguccaucguccccagcgccggaggcuauggcucuggguacaucgauugccucauuccucaggaaugggugcaacacuuuuaucaggaggcugcccccucccagagcgcgguugcccuggugagauacgucaauccugacaccggacgcaacaucuucgaagcuaaacuucaucgggagggcuuucugacaguggccaauucugggaacaaucccauugugguuccucccaacggauauuucagauuugaggcuugggucaaccaguucuacacgcucgccccgaugggcagcgggcaaggccgccggagagcgcaguga

SEQ ID NO: 26692 - RNA, 1623 nt, Artificial Sequence; identical to SEQ ID NO: 26475
  derived and/or modified sequence opt5 from capsid_protein_VP1__Norovirus__AII02626

SEQ ID NO: 26693 - RNA, 1647 nt, Artificial Sequence
  derived and/or modified sequence opt5 from capsid_protein_VP1__Norovirus__AII02629
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaaccguucucccugcccauccucaccauuagcgaaaugucuaauuccagauuuccugugcccaucgacagccugcauacgucuccuaccgagaacaucgugguccagugccagaauggacgggugacacuggauggcgagcucauggggaccacacaacugcuucccucccagauuugugcguuccgcggaaugcugaccagaagcacgucccgggccucugaccaggcugauacagccaccccgcgccucuucaacuauuacuggcacauccagcuggacaaucuuaacggcacaccuuaugaccccgccgaagauauuccuggcccccuggggaccccugacuuuagaggaaagguuuucggcguggcuagccaacggaaucccgaugccaccacacgcgcgcaugaggcuaaaaucgacacgaccuccgggagauuuacaccgaagcucggaagccuggaaauuucuaccgaguccggcgauuucgaccagaaccagccuacacgguuuacccccgucgggaucggaguggaucacgaagccgacuuccaacaguggacgcugcccgauuacgccggccaguuuacacacaauaugaaccucgcuccugccguugcuccgaauuuccccggcgagcagcugcuguuuuucagaagccaacuuccuucuagcgggggacgcuccaacggcauccucgacugccuggugccccaggaguggguccagcauuuuuaccaggaaucugccccuagccaaacccagguggcgcuuguccgguaugugaaucccgauaccgggagaguucuguucgaggccaagcuccacaaacugggauuuaugacaauugcuaaguccggcgacagcccuaucaccgugcccccgaacggguacuuccgcuucgaaucuugggucaacccuuuuuauacacuggcccccaugggcacgggaaauggccggagacgcauucaguga

SEQ ID NO: 26694 - RNA, 1623 nt, Artificial Sequence; identical to SEQ ID NO: 26525
  derived and/or modified sequence opt5 from capsid_protein_VP1__Norovirus__AII02632

SEQ ID NO: 26695 - RNA, 1623 nt, Artificial Sequence; identical to SEQ ID NO: 26475
  derived and/or modified sequence opt5 from capsid_protein_VP1__Norovirus__AII02635

SEQ ID NO: 26696 - RNA, 1608 nt, Artificial Sequence; identical to SEQ ID NO: 26688
  derived and/or modified sequence opt5 from capsid_protein_VP1__Norovirus__AII02638

SEQ ID NO: 26697 - RNA, 1623 nt, Artificial Sequence; identical to SEQ ID NO: 26475
  derived and/or modified sequence opt5 from capsid_protein_VP1__Norovirus__AII02641

SEQ ID NO: 26698 - RNA, 1647 nt, Artificial Sequence; identical to SEQ ID NO: 26693
  derived and/or modified sequence opt5 from capsid_protein_VP1__Norovirus__AII02644

SEQ ID NO: 26699 - RNA, 1623 nt, Artificial Sequence; identical to SEQ ID NO: 26510
  derived and/or modified sequence opt5 from capsid_protein_VP1__Norovirus__AII02647

SEQ ID NO: 26700 - RNA, 1623 nt, Artificial Sequence; identical to SEQ ID NO: 26522
  derived and/or modified sequence opt5 from capsid_protein_VP1__Norovirus__AII02650

SEQ ID NO: 26701 - RNA, 1623 nt, Artificial Sequence
  derived and/or modified sequence opt5 from capsid_protein_VP1__Norovirus__AII02653
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagccugaacuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagagauguucacaacgugcaucuugccccggcugucgcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacgccgcucugcuucgcuuugugaaccccgauacaggcagaguucuguucgaguguaaacuccauaaguccggguaugucaccguggcccacacgggccagcacgaccuggugaucccgccuaauggauacuuucgguucgauagcugggucaaccaguucuauacccuugcucccaugggcaacgggacaggaagacgccgggcccuguga

SEQ ID NO: 26702 - RNA, 1647 nt, Artificial Sequence; identical to SEQ ID NO: 26693
  derived and/or modified sequence opt5 from capsid_protein_VP1__Norovirus__AII02656

SEQ ID NO: 26703 - RNA, 1623 nt, Artificial Sequence; identical to SEQ ID NO: 26475
  derived and/or modified sequence opt5 from capsid_protein_VP1__Norovirus__AII02659

SEQ ID NO: 26704 - RNA, 1647 nt, Artificial Sequence; identical to SEQ ID NO: 26693
  derived and/or modified sequence opt5 from capsid_protein_VP1__Norovirus__AII02662

SEQ ID NO: 26705 - RNA, 1623 nt, Artificial Sequence; identical to SEQ ID NO: 26475
  derived and/or modified sequence opt5 from capsid_protein_VP1__Norovirus__AII02665

SEQ ID NO: 26706 - RNA, 1623 nt, Artificial Sequence; identical to SEQ ID NO: 26475
  derived and/or modified sequence opt5 from capsid_protein_VP1__Norovirus__AII02668

SEQ ID NO: 26707 - RNA, 1623 nt, Artificial Sequence; identical to SEQ ID NO: 26475
  derived and/or modified sequence opt5 from capsid_protein_VP1__Norovirus__AII02671

SEQ ID NO: 26708 - RNA, 1623 nt, Artificial Sequence
  derived and/or modified sequence opt5 from capsid_protein_VP1__Norovirus__AII02674
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacagucuacaccggguccgccccguuuacgccuaaacucggaagcgugcaguucuccacagacaccgaaaacgauuuugaggcccaucaaaauaccaaguucacacccguuggcgugauccaggacggcgggaccacacaccgcaacgaaccccagcaauggguccugccuucuuacagcggaagagaugugcacaauguucaucuugcuccggccguggcgcccacguuuccuggcgagcagcuccuguucuuucgguccaccaugcccggguguagcggauauccuaacauggaccuggauugccugcucccccaggaguggguccagcacuucuaccaagaagcugccccugcccagucugacguggcucugcuucgcuuugugaaucccgauacaggcagaguucuguucgaguguaaacuccauaaguccggguaugucaccguggcccacacaggccagcacgaccuggugauuccgccuaacggauacuuucgguucgauagcugggucaaccaguucuauacccuugcucccaugggcaaugggacgggaagacgccgggcccuguga

SEQ ID NO: 26709 - RNA, 1623 nt, Artificial Sequence; identical to SEQ ID NO: 26518
  derived and/or modified sequence opt5 from capsid_protein_VP1__Norovirus__AII02677

SEQ ID NO: 26710 - RNA, 1623 nt, Artificial Sequence
  derived and/or modified sequence opt5 from capsid_protein_VP1__Norovirus__AII02680
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagauuaaugaccccacaaucaagcucauugccaugcuguauacaccccuucgcgcuaacaacgccggcgaagauguuuucaccgugagcugcagagugcugacccggccuuccccggacuuugauuucaucuuucucgugcccccuacagucgagagccgcaccaaacccuucacgguuccuauucugaccguggaagagaugacaaauucuagauuucccaucccgcuugagaagcuguucaccgggccuuccggagccuucgucgugcagccccagaacggccgguguacaaccgacgggguucuccugggaacgacacaacugagcccugugaauaucugcaccuuucgcggcgaugucacacauauugcuggcucuagaaacuacaccaugaaucucgcgucccugaacuggaauaacuaugaccccaccgaagagaucccugcuccccuugggacaccggauuucgugggaaaaauucagggcguccugacgcagaccacaaagggggacggaagcacccggggccacaaggccacaguguacaccgggucugccccuuuuacgcccaaacucggauccguucaguucagcacagacaccgaaaaugauuuugagacccaucaaaacacaaaguucacccccgugggcgucauccaggacggcuccacaacgcaccgcaaugaaccucagcaaugggugcugccgucuuacagcgggagagauauucacaacguucaucuugcccccgcuguggccccuaccuuucccggagagcagcuccuguucuuucgguccacaaugccuggcuguagcggguaucccaauauggaccuggauugccugcucccucaggaguggguccagcacuucuaccaagaagcggcucccgcccagucugacguggcccugcuucgcuuugugaacccggauaccggaagaguucuguucgaguguaaacuccauaaguccggcuaugucacaguggcucacaccgggcagcacgaccuggugaucccucccaauggcuacuuucgguucgauagcugggucaaccaguucuauacgcuugccccuaugggaaacggcaccgggagacgccgggcucuguga

SEQ ID NO: 26711 - RNA, 1623 nt, Artificial Sequence; identical to SEQ ID NO: 26475
  derived and/or modified sequence opt5 from capsid_protein_VP1__Norovirus__AII02683

SEQ ID NO: 26712 - RNA, 1623 nt, Artificial Sequence; identical to SEQ ID NO: 26475
  derived and/or modified sequence opt5 from capsid_protein_VP1__Norovirus__AII02689

SEQ ID NO: 26713 - RNA, 1623 nt, Artificial Sequence; identical to SEQ ID NO: 26562
  derived and/or modified sequence opt5 from capsid_protein_VP1__Norovirus__AII02692

SEQ ID NO: 26714 - RNA, 1623 nt, Artificial Sequence; identical to SEQ ID NO: 26525
  derived and/or modified sequence opt5 from capsid_protein_VP1__Norovirus__AII02695

SEQ ID NO: 26715 - RNA, 1623 nt, Artificial Sequence; identical to SEQ ID NO: 26475
  derived and/or modified sequence opt5 from capsid_protein_VP1__Norovirus__AII02698

SEQ ID NO: 26716 - RNA, 1623 nt, Artificial Sequence; identical to SEQ ID NO: 26475
  derived and/or modified sequence opt5 from capsid_protein_VP1__Norovirus__AII02701

SEQ ID NO: 26717 - RNA, 1623 nt, Artificial Sequence; identical to SEQ ID NO: 26475
  derived and/or modified sequence opt5 from capsid_protein_VP1__Norovirus__AII02707

SEQ ID NO: 26718 - RNA, 1623 nt, Artificial Sequence; identical to SEQ ID NO: 26529
  derived and/or modified sequence opt5 from capsid_protein_VP1__Norovirus__AII02710

SEQ ID NO: 26719 - RNA, 1647 nt, Artificial Sequence
  derived and/or modified sequence opt5 from capsid_protein_VP1__Norovirus__AII02713
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaaccguucucccugcccauccucaccauuagcgaaaugucuaauuccagauuuccugugcccaucgacagccugcauacgucuccuaccgagaacaucgugguccagugccagaauggacgggugacacuggauggcgagcucauggggaccacacaacugcuucccucccagauuugugcguuccgcggaaugcugaccagaagcacgucccgggccucugaccaggcugauacagccaccccgcgccucuucaacuauuacuggcacauccagcuggacaaucuuaacggcacaccuuaugaccccgccgaagauauuccuggcccccuggggaccccugacuuuagaggaaagguuuucggcguggcuagccaacggaaucccgaugccaccacacgcgcgcaugaggcuaaaaucgacacgaccuccgggagauuuacaccgaagcucggaagccuggaaauuucuaccgaguccggcgauuucgaccagaaccagccuacaaucuuuacccccgucgggaucggaguggaucacgaagccgacuuccaacaguggacgcugcccgauuacgccggccaguuuacacacaauaugaaccucgcuccugccguugcuccgaauuuccccggcgagcagcugcuguuuuuccggagccaacuuccuucuagcgggggaagauccaacggcauucucgacugccuggugccccaggaguggguccagcauuuuuaccaggaaucugccccuagccaaacccagguggcgcuuguccgcuaugugaaucccgauaccgggcggguucuguucgaggccaagcuccacaaacugggauuuaugacaaucgcuaaguccggcgacagcccuauuaccgugcccccgaacggguacuucagauucgaaucuugggucaacccuuuuuauacacuggcccccaugggcacgggaaauggccgccggagaauccaguga

SEQ ID NO: 26720 - RNA, 1647 nt, Artificial Sequence; identical to SEQ ID NO: 26693
  derived and/or modified sequence opt5 from capsid_protein_VP1__Norovirus__AII02716

SEQ ID NO: 26721 - RNA, 1650 nt, Artificial Sequence
  derived and/or modified sequence opt5 from capsid_protein_VP1__Norovirus__AII02719
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccuagaaauucccccggggaaaugcugcuuaaccuggagcucggaccugagcugaauccguaccuuucucaccugagccgcauguauaacggcuacgccgggggaaugcaagugcaggucgugcucgccggcaaugcuuucacagccggcaaaaucauuuuugcugccguucccccucauuuccccguggaaaacaucaaugcggcccagaucacgaugugcccucacgucauuguggaugugagacagcuggagcccguccugcucccgcugccugacauccggaaccgcuuuuuccauuauaaucaggaagauacccccagaaugcggcuuguugcuaugcuguacacaccucuccgcgccaacuccggggaggacguguuuaccgugucuuguagaguccugacacggcccgcucccgauuucgaguuuaccuuccuugugccuccgacaguugaaagcaagaccaaacccuuuacgcugccuauucucacccugggagagcuguccaacagccgcuuccccgccccuaucgacaugcucuauacagaucccaaugaaggcauugugguccaaccgcagaacgggagaugcacccuggacggaacacuucagggcaccacgcagcuggugccuacacaaaucugugccuuucgggggauucucaucggacagaccucucgcucccccgauagcgacucuacagauuccgcuccuagacggcgcgaccacccccugcauaugcagcuugagaaucuggacggcacccaauacgauccuaccgacgaaguucccgcggcccucggcgcuguggauuucaaggggacaaucuucggagucgccagccagagagacacgucuggcacccaggugggggccacacgggcucacgaggucauuaucaacaccacagauccgagauauaccccuaaacugggauccgugcugauguacagcgagucccaggacuuugaaacgggccaacccauucgcuucacacccaucgggaugggagagaaugauuggcaccagugggaacucccuaacuacucuggccggcugacccuuaauaugaaccuggccccggcgguugcucccgccuuuccuggcgagcggauucucuucuuucgcagcaucgugcccuccgccgggggauauggcagcgggcagaucgacugccugcuuccucaggaauggguccaacauuucuaccaggaggcugcccccucucaguccgcuguggcccugauucgguauguuaauccugauaccggaagaaacaucuuugaggcgaagcuccaccgcgaaggcuucauuacaguggccaauagcgggaacaaucccaucgucgugccgccuaacggcuacuuucgguucgaggcuugggugaaucaguuuuauacccugacacccaugggaacgggccaagggagacgccggaaccaguga

SEQ ID NO: 26722 - RNA, 1650 nt, Artificial Sequence
  derived and/or modified sequence opt5 from capsid_protein_VP1__Norovirus__AII02722
augaagauggccagcaacgacgcugcccccuccaaugauggcgcggcuaaccuggugccugaggccaauaacgaagucauggcccucgagccgguugcuggggccucuaucgcugcccccguggugggacagcaaaauauuaucgacccuuggauuagagaaaacuucguccaggcgccccagggcgaguuuaccgugagcccucgcaauucccccggggaaaugcugcuuaaccuggagcucggaccugagcugaauccguaccuuucucaccugagccggauguauaacggcuacgccgggggaaugcagguucaagugguccucgcuggcaaugccuucacagcuggcaaaaucauuuuugccgcggugcccccucauuuccccguugaaaacaucaaugccgcucagaucacgaugugcccucacgugauugucgaugugagacagcuggagcccgugcugcucccgcugccugacauccggaaccgcuuuuuccauuauaaucaggaagauacccccagaaugcggcuugucgccaugcuguacacaccucuccgcgcuaacuccggggaggacguuuuuaccgugucuuguagagugcugacacggcccgcccccgauuucgaguuuaccuuccuugucccuccgacaguggaaagcaagaccaaacccuuuacgcugccuauucucacccugggagagcuguccaacagccgcuuccccgccccuaucgacaugcucuauacagaucccaaugaaggcauuguugugcaaccgcagaacgggagaugcacccuggacggaacacuucagggcaccacgcagcuggucccuacacaaaucugugcuuuucgggggcgccucauuggacagaccucuagaucccccgaucuggacagcacagauucugcgccucggcgcagagaccacccccuucauaugcagcuggagaaucucgacggcacccaauacgauccuaccgacgaagugcccgccgcucugggcgccguugauuucaaggggacaaucuucggaguggccucccagcgggacacgagcggcucucaggucggggcuaccagagcccacgaggugacaaucaacaccacagauccgcgcuauaccccuaaacugggauccguccucauguacagcgagucccaggacuuugaaacgggccaacccauucgguucacacccaucgggaugggagaggaugacuggcaccagugggaacugccuaauuacucuggcagacuuacccugaacaugaaucucgcgccggcuguggcccccgccuuuccuggcgagcgcauucuguucuuucggagcaucguucccuccgcugggggauauggcagcgggcagauugauugccuucugccucaggaaugggugcaacauuucuaccaggaggccgcucccucucaguccgccgucgcgcucaucagauaugugaacccugacaccggacgcaauaucuuugaggccaagcugcaccgggaaggcuucauuacaguugcuaacagcgggaauaaccccaucguggucccgccuaauggcuacuuuagauucgaggccugggugaaccaguuuuauacccugacacccaugggaacgggccaagggcgccggagaaaucaguga

SEQ ID NO: 26723 - RNA, 1623 nt, Artificial Sequence
  derived and/or modified sequence opt5 from capsid_protein_VP1__Norovirus__AII02725
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccugucccccuugagaagcuguucacagggccgagcggagccuucgugguucagccucagaacggccgguguaccacggacggggugcuccugggaacaacccaacugucucccgucaauauuugcacauuucgcggcgaugugacccauaucgcuggcuccagaaacuacaccaugaaucucgcgagccugaacuggaauaacuaugacccuacagaagagauccccgccccucuugggacgcccgauuucgucggaaaaauucagggcgugcugacccagacaaccaagggggacggaucuacacggggccacaaggcuaccguuuacacgggguccgccccguuuacaccuaaacucggaagcgugcaguucuccaccgacaccgaaaaugauuuugagacacaucaaaacaccaaguucacacccgucggcgugauccaggacggcgggacgacccaccgcaaugaaccccagcaauggguucugccuucuuacagcggaagagaugugcacaacguccaucuugccccggcuguggcccccacauuuccuggcgagcagcuccuguucuuucgguccaccaugcccggguguagcggauauccuaauauggaccuggauugccugcucccccaggagugggugcagcacuucuaccaagaagcggcuccugcccagucugacguugcccugcuucgcuuugucaaccccgauacaggcagagugcuguucgaguguaaacuccauaaguccggguaugugaccgucgcucacacgggccagcacgaccuggugauuccgccuaauggauacuuucgguucgauagcuggguuaaccaguucuauacccuugcccccaugggcaacgggacaggaagacgccgggcucuguga

SEQ ID NO: 26724 - RNA, 1623 nt, Artificial Sequence
  derived and/or modified sequence opt5 from capsid_protein_VP1__Norovirus__AII02728
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugaccccaccauuaagcucaucgccaugcuguauacaccccuucgcgcuaacaacgccggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaauucuagauuucccauuccgcuugagaagcuguucacagggccuuccggagccuucgucgugcagccccagaacggccgguguaccacggacgggguucuccugggaacaacccaacugagcccugugaauaucugcacauuucgcggcgaugucacccauaucgcuggcucuagagacuacaccaugaaccucgcgucccugaauuggaacaauuaugaucccacagaagagauuccugcuccccuugggacgccggacuucgugggaaaaauccagggcguccugacccagacaacccgcggggacggaagcacacggggccacaaggccaccguguacacggggucugccccuuuugcccccaagcucggauccguucaguucagcacagauaccgaaaacgacuuugagacccaucaaaauacaaaauucacccccgugggcgucauucaggauggcgggacaacgcacagaaacgaaccucagcaaugggugcugccguccuacucuggacgggacguucacaaugugcaucuugcucccgccgucgcgccuaccuuucccggcgagcagcuccuguucuuucgcagcacaaugccuggguguuccggauaucccaacauggaucuggacugccugcucccucaggagugggugcagcacuucuaccaagaagcugcccccgcccagagcgauguggcucugcuuagauuuguuaauccggacaccggccggguccuguucgaguguaagcuccauaaaucuggguaugugacaguggcccacaccggccagcacgaucuggucaucccucccaacggauacuuuagauucgacuccugggugaaucaguucuauacgcuugcuccuaugggcaacgggaccggacgccggagagcccuguga

SEQ ID NO: 26725 - RNA, 1653 nt, Artificial Sequence
  derived and/or modified sequence opt5 from capsid_protein_VP1__Norovirus__AII02731
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccgccaucgacaugcucuauacagauccuaaugaguccauugugguccaaccccagaacggcagaugcacccuggacgggacacuucagggaaccacgcagcuggugccgacacaaaucugugcuuuucggggcacccucauuagccagacagcgcgcgccgcugauucuaccgacuccccucagagagcccggaaucacccccugcauguucaagugaagaaccuugaugggacccaguacgacccuacagacgauauccccgccguccugggagcuaucgacuucaaaggcacgguguucggcgucgccagccagcgcgaugugucugggacccaggaacaaggacacuaugcgacaagagcucacgaggcccauauugacaccacagauccuaaguacgcccccaagcucggcaccauccugauuaaauccgaaagcacggacuuuaauacaaaccagccgauccgguucaccccuguugggaugggagauaauaacuggagacagugggagcugcccgacuacuccggcucucucacccugaauaugaaccuugcucccgccgugagcccuuccuuuccgggggagcgcauucuguucuuucggagcaucguccccucugcuggaggcuauggcuccggguacaucgauugccucauuccucaggaaugggugcaacacuucuaucaggaggccgcgcccagccagucugccguugcucuggugagauacgucaauccugacacaggacgcaacaucuuugaagccaaacuucaucgggagggcuuccugaccguggcuaauagcgggaacaaucccauugugguuccucccaacggauauuuuagauucgaagccugggucaaccaguuuuacacacucgcgccgaugggcuccgggcaaggccgccggagagcccaguga

SEQ ID NO: 26726 - RNA, 1623 nt, Artificial Sequence; identical to SEQ ID NO: 26475
  derived and/or modified sequence opt5 from capsid_protein_VP1__Norovirus__AII02734

SEQ ID NO: 26727 - RNA, 1623 nt, Artificial Sequence; identical to SEQ ID NO: 26475
  derived and/or modified sequence opt5 from capsid_protein_VP1__Norovirus__AII02737

SEQ ID NO: 26728 - RNA, 1623 nt, Artificial Sequence
  derived and/or modified sequence opt5 from capsid_protein_VP1__Norovirus__AII02740
augaagauggcccccaacgacgcuaauccuagcgauggcuccgccgcgaaccuggugccggaggucucuaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucuguggggcgccccgcuugggcccgaucugaacccuuaccucucccaccuggcucgcauguauaauggauacgccggcggcuucgaaguccaggugauccuugcugggaacgccuuuacagcgggaaaaauuaucuucgccgcuguucccccuaauuuucccacggagggccugucuccgagccaggugaccauguucccucauaucauugucgacgugagacaacucgagcccgugcugaucccucugcccgauguccggaacaauuuuuaucacuacaaccagacaaaugacuccaccauuaagcucaucgccaugcuguauacaccccuucgcgcuaacaacgccggggaagauguuuucaccgugucuugcagagugcugacacggccuagcccggacuuugauuucauuuuucucgugcccccuaccgucgagucccgcacgaaacccuucaccguuccuauccugacaguggaagagaugaccaauagcagauuucccauuccgcuugagaagcuguucacaggaccuucuggcgccuucgucgugcagccccagaacgggcgguguaccacggacggaguucuccugggcacaacccaacuguccccugugaauaucugcacauuucgcggcgaugucacccauaucgcugggagcagaaacuacaccaugaaucucgcgucucugaacuggaauaacuaugaccccacagaagagauuccugcuccccuuggaacgccggauuucgugggcaaaauccaggggguccugacccagacaaccaagggagacggcuccacacgggggcacaaggccaccguguacacgggaagcgccccuuuuacacccaaacucggcucuguucaguucuccaccgacaccgaaaaugauuuugagacacaucaaaacaccaaguucacacccgugggcgucauucaggacgggggaacgacccaccgcaaugaaccucagcaaugggugcugccgagcuacuccggcagagauguucacaacgugcaucuugcccccgcugucgccccuacauuucccggggagcagcuccuguucuuucggucuaccaugccuggauguagcggcuaucccaauauggaccuggauugccugcucccucaggagugggugcagcacuucuaccaagaagcggcucccgcccaguccgacguggcccugcuucgcuuuguuaacccggauacagggagaguccuguucgaguguaaacuccauaagagcggcuaugugaccguggcucacaauggacagcacgaccuggucaucccucccaacggcuacuuucgguucgauucuugggugaaccaguucuauacgcuugccccuauggggaauggaaccggcagacgccgggcucuguga

SEQ ID NO: 26729 - RNA, 1623 nt, Artificial Sequence; identical to SEQ ID NO: 26508
  derived and/or modified sequence opt5 from capsid_protein_VP1__Norovirus__AII02743

SEQ ID NO: 26730 - RNA, 1623 nt, Artificial Sequence; identical to SEQ ID NO: 26708
  derived and/or modified sequence opt5 from capsid_protein_VP1__Norovirus__AII02746

SEQ ID NO: 26731 - RNA, 1623 nt, Artificial Sequence; identical to SEQ ID NO: 26475
  derived and/or modified sequence opt5 from capsid_protein_VP1__Norovirus__AII02749

SEQ ID NO: 26732 - RNA, 1623 nt, Artificial Sequence; identical to SEQ ID NO: 26557
  derived and/or modified sequence opt5 from capsid_protein_VP1__Norovirus__AII02752

SEQ ID NO: 26733 - RNA, 1623 nt, Artificial Sequence; identical to SEQ ID NO: 26522
  derived and/or modified sequence opt5 from capsid_protein_VP1__Norovirus__AII02758

SEQ ID NO: 26734 - RNA, 1623 nt, Artificial Sequence
  derived and/or modified sequence opt5 from capsid_protein_VP1__Norovirus__AII02761
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcaucucaucgucgacgugagacaacuggagccugugcugauuccccucccugauguccggaacaauuuuuaucacuacaaccagagcaaugaccccaccaucaagcugauugcuaugcuuuauacaccccugcgcgccaacaacgcuggcgaugacguuuucaccguguccugcagagugcucacacggccuagcccggauuuugacuucaucuuucuggugcccccuaccgucgaaucucgcacgaaacccuucuccguuccugugcuuaccgucgaggaaaugacaaauagcagauuucccauuccgcuggagaagcuguucaccgggccuucuuccgccuucgugguucagccccagaacggacgguguacaaccgauggcgugcugcuggggacgacacaacucagcccugucaauaucugcaccuuucgcggagacgugacacauauuucuggcuccagaaacuacaccaugaaucuggccagccagaacuggaacuccuaugaucccaccgaggaaaucccugcuccccuuggcacaccggacuucgucgggaaaauccagggagugcugacgcagaccacacggaccaauggcucuacacgcgggcacaaggcgaccguuuacacgggaagcgccgacuuuuccccuaagcucggcagagugcaauucgcuacagauaccgacaaugauuuugagaccaaccagaauacaaaauucacccccgucggggugauucaggacggaagcacaacgccccggaacgaaccucaacaguggguucugccgucuuacuccggccgcaauauccauaacgugcaccuugcccccgccgucgcuccuaccuuucccggcgagcagcuccucuucuuuagaagcacaaugccuggguguucuggauaucccaauauggaucuggacugccugcucccucaggaaugggugcaauacuucuaucaggaggccgcgcccgcucagagcgauguggcccugcuucgguuuguuaacccggacaccggcagaguccuguucgaguguaagcuccacaaauccggguacgugacaguggcccauaccggacagcacgaucuggucauuccucccaacggcuauuuucgcuucgacucuugggugaaucaauucuacacgcuugcuccuauggggaacggcaccggacggagacgcgcccuguga

SEQ ID NO: 26735 - RNA, 1623 nt, Artificial Sequence; identical to SEQ ID NO: 26475
  derived and/or modified sequence opt5 from capsid_protein_VP1__Norovirus__AII02764

SEQ ID NO: 26736 - RNA, 1623 nt, Artificial Sequence; identical to SEQ ID NO: 26475
  derived and/or modified sequence opt5 from capsid_protein_VP1__Norovirus__AII02767

SEQ ID NO: 26737 - RNA, 1647 nt, Artificial Sequence; identical to SEQ ID NO: 26693
  derived and/or modified sequence opt5 from capsid_protein_VP1__Norovirus__AII02770

SEQ ID NO: 26738 - RNA, 1623 nt, Artificial Sequence; identical to SEQ ID NO: 26475
  derived and/or modified sequence opt5 from capsid_protein_VP1__Norovirus__AII02773

SEQ ID NO: 26739 - RNA, 1650 nt, Artificial Sequence
  derived and/or modified sequence opt5 from capsid_protein_VP1__Norovirus__AII02776
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccuagaaauucccccggggaaaugcugcuuaaccuggagcucggaccugagcugaauccguaccuuucucaccugagccgcauguauaacggcuacgccgggggaaugcaagugcaggucgugcucgccggcaaugcuuucacagccggcaaaaucauuuuugcugccguucccccucauuuccccguggaaaacaucaaugcggcccagaucacgaugugcccucacgucauuguggaugugagacagcuggagcccguccugcucccgcugccugacauccggaaccgcuuuuuccauuauaaucaggaagauacccccagaaugcggcuuguugcuaugcuguacacaccucuccgcgccaacuccggggaggacguguuuaccgugucuuguagaguccugacacggcccgcucccgauuucgaguuuaccuuccuugugccuccgacaguugaaagcaagaccaaacccuuuacgcugccuauucucacccugggagagcuguccaacagccgcuuccccgccccuaucgacaugcucuauacagaucccaaugaaggcauugugguccaaccgcagaacgggagaugcacccuggacggaacacuucagggcaccacgcagcuggugccuacacaaaucugugccuuucgggggauucucaucggacagaccucucgcucccccgauagcgacucuacagauuccgcuccuagacggcgcgaccacccccugcauaugcagcuugagaaucuggacggcacccaauacgauccuaccgacgaaguucccgcggcccucggcgcuguggauuucaaggggacaaucuucggagucgccagccagagagacacgucuggcucccaggugggggccacccgggcucacgaggucauuaucaacacaaccgauccgagauauacaccuaaacugggaagcgugcugauguacuccgagucucaggacuuugaaaccggccaacccauucgcuucacgcccaucgggaugggagagaaugauuggcaccagugggaacucccuaacuacagcggccggcugacacuuaauaugaaccuggccccggcgguugcucccgccuuuccuggcgagcggauucucuucuuucgcuccaucgugcccagcgccgggggauauggcucugggcagauggacugccugcuuccucaggaauggauccaacauuucuaccaggaggcugcccccucccagagcgcugucgcccugauucgguaugugaauccugauaccggaagaaacaucuuugaggcgaagcuccaccgcgaaggcuucauuaccguugccaauucugggaacaaucccaucguggucccgccuaacggcuacuuucgguucgaggcuugggugaaucaguuuuauacacugacccccaugggaacaggccaagggagacgccggaaccaguga

SEQ ID NO: 26740 - RNA, 1623 nt, Artificial Sequence; identical to SEQ ID NO: 26475
  derived and/or modified sequence opt5 from capsid_protein_VP1__Norovirus__AII02779

SEQ ID NO: 26741 - RNA, 1623 nt, Artificial Sequence; identical to SEQ ID NO: 26475
  derived and/or modified sequence opt5 from capsid_protein_VP1__Norovirus__AII02782

SEQ ID NO: 26742 - RNA, 1623 nt, Artificial Sequence
  derived and/or modified sequence opt5 from capsid_protein_VP1__Norovirus__AII02785
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagacaaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcggagccuucgucgugcagccucagaacggccgguguaccacggacgggguucuccugggaacaacccaacugucucccgugaauaucugcacauuucgcggcgaugucacccauaucgcuggcuccagaaacuacaccaugaaucucgcgagcauuaacuggaauaacuaugacccuacagaagagauccccgccccucuggggacgcccgauuucgugggaaaaauucagggcguccuuacccagacaaccaagggggacggaucuacacggggccacaaggcuaccguguacacgggguccgccccguuuacaccuaaacugggaagcguucaguucuccaccgacaccgaaaaugauuuugagacacaucaaaacaccaaguucacacccgugggcgucauccaggacggcgggacgacccaccgcaaugaaccccagcaaugggugcucccuucuuacagcggaagagauguucacaacgugcaucuggccccggcugucgcccccacauuuccuggcgagcagcuucuguucuuucgguccaccaugcccggguguagcggauauccuaauauggaccucgauugccugcugccccaggagugggugcagcacuucuaccaagaagcggcuccugcccagucugacgccgcucuccugcgcuuugugaaccccgauacaggcagaguucuuuucgaguguaaacugcauaaguccggguaugucaccguggcccacacgggccagcacgaccucgugauuccgccuaauggauacuuucgguucgauagcugggucaaccaguucuauacccuggcucccaugggcaacgggacaggaagacgccgggcccuuuga

SEQ ID NO: 26743 - RNA, 1647 nt, Artificial Sequence; identical to SEQ ID NO: 26693
  derived and/or modified sequence opt5 from capsid_protein_VP1__Norovirus__AII02788

SEQ ID NO: 26744 - RNA, 1647 nt, Artificial Sequence; identical to SEQ ID NO: 26693
  derived and/or modified sequence opt5 from capsid_protein_VP1__Norovirus__AII02791

SEQ ID NO: 26745 - RNA, 1623 nt, Artificial Sequence
  derived and/or modified sequence opt5 from capsid_protein_VP1__Norovirus__AII02794
augaagauggccagcuccgacgcuaaccccucugauggcagcaccgccucccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugguucuugccggcaaugcuuuuacggccgggaaaaucauuuucgcggccgugccucccaacuuuccuaccgagggacugucucccagccaggucacaauguucccgcauaucaucguggacgugagacaacucgagccuguccugauuccccugccugauguucggaauaacuuuuaucacuacaaucaguccaacgaccccaccaucaagcucauugcuaugcuguauacaccccuucgcgccaauaacgcuggcgaugacguguucaccgugagcugcagaguccugacacggccuucuccggauuuugacuucaucuuucucgugcccccuaccguugaaucccgcacgaaacccuucagcgugccuguccugaccguggaggaaaugacaaacucuagauuucccauuccgcuugagaagcuguucaccgggccuuccagcgccuucguugugcagccccagaauggacgguguacaaccgauggcguccuccuggggacgacacaacugucuccugugaacaucugcaccuuucgcggagacgucacacauauuuccggcagcagaaauuacaccaugaaccucgccucccagucuuggaauagcuaugaucccaccgaggaaaucccugcuccccugggcuccccggacuucguggggaaaauccagggaguucuuacacagacgacccggacaaacggcagcacccgcgggcacaaggcgacaguguacaccggaucugccgacuuuuccccuaagcugggcagaguccaauucgcuacggauacagacaaugauuuugagaccaaccagaauaccaaauucacacccguggggguuauucaggacggaagcaccacaccccggaacgaaccucaacagugggugcucccgucuuacagcggccgcaauauccauaacguccaccuggcccccgccguggcuccuacguuucccggcgagcagcuucuguucuuuagauccaccaugccuggguguucuggauaucccaauauggaucucgacugccugcugccucaggaaugggugcaauacuucuaucaggaggccgcgcccgcucagagcgauguugcccuccugcgguuugucaacccggacacaggcagagugcuuuucgaguguaagcugcacaaauccggguacgugaccgucgcccauacaggacagcacgaucucgugauuccucccaauggcuauuuucgcuucgacagcuggguuaaccaauucuacacccuggcuccuauggggaacggcacgggacggagacgcgcccuuuga

SEQ ID NO: 26746 - RNA, 1623 nt, Artificial Sequence; identical to SEQ ID NO: 26475
  derived and/or modified sequence opt5 from capsid_protein_VP1__Norovirus__AII02797

SEQ ID NO: 26747 - RNA, 1623 nt, Artificial Sequence; identical to SEQ ID NO: 26475
  derived and/or modified sequence opt5 from capsid_protein_VP1__Norovirus__AII02800

SEQ ID NO: 26748 - RNA, 1623 nt, Artificial Sequence; identical to SEQ ID NO: 26724
  derived and/or modified sequence opt5 from capsid_protein_VP1__Norovirus__AII02803

SEQ ID NO: 26749 - RNA, 1623 nt, Artificial Sequence; identical to SEQ ID NO: 26475
  derived and/or modified sequence opt5 from capsid_protein_VP1__Norovirus__AII02806

SEQ ID NO: 26750 - RNA, 1623 nt, Artificial Sequence; identical to SEQ ID NO: 26708
  derived and/or modified sequence opt5 from capsid_protein_VP1__Norovirus__AII02809

SEQ ID NO: 26751 - RNA, 1647 nt, Artificial Sequence; identical to SEQ ID NO: 26693
  derived and/or modified sequence opt5 from capsid_protein_VP1__Norovirus__AII02812

SEQ ID NO: 26752 - RNA, 1623 nt, Artificial Sequence
  derived and/or modified sequence opt5 from capsid_protein_VP1__Norovirus__AII02815
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagagacuacaccaugaaucucgcgagccugaacuggaauaacuaugauccuaccgaagagauccccgccccucuugggacacccgacuucgucggaaaaauucagggcgugcugacgcagaccacaaagggggacggaucuacccggggccacaaggcuacagucuacaccggguccgccccguuuacgccuaaacucggaagcgugcaguucuccacagauaccgaaaaugacuuugaggcccaucaaaacaccaaguucacacccguuggcgugauccaggauggcgggaccacacaccgcaaugaaccccagcaauggguccugccuucuuacagcggaagagacgugcacaacguucaucuugcuccggccguggcgcccacguuuccuggcgagcagcuccuguucuuucgguccaccaugcccggguguagcggauauccuaauauggaucuggacugccugcucccccaggaguggguccagcacuucuaccaagaagcugccccugcccagucugauguggcucugcuucgcuuugugaaccccgacacaggcagaguucuguucgaguguaaacuccauaaguccggguaugucaccguggcccacacaggccagcacgaucuggugauuccgccuaauggauacuuucgguucgacagcugggucaaccaguucuauacccuugcucccaugggcaacgggacgggaagacgccgggcccuguga

SEQ ID NO: 26753 - RNA, 1647 nt, Artificial Sequence
  derived and/or modified sequence opt5 from capsid_protein_VP1__Norovirus__AII02818
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaaccguucucccugcccauccucaccauuagcgaaaugucuaauuccagauuuccugugcccaucgacagccugcauacgucuccuaccgagaacaucgugguccagugccagaauggacgggugacacuggauggcgagcucauggggaccacacaacugcuucccucccagauuugugcguuccgcggaaugcugaccagaagcacgucccgggccucugaccaggcugauacaguuaccccgcgccucuucaacuauuacuggcacauccagcuggacaaucuuaacggcacaccuuaugaccccgccgaagauauuccuggcccccuggggaccccugacuuuagaggaaagguguucggcgucgccagccaacggaaucccgaugcuaccacacgcgcccaugaggcgaaaaucgacacgaccuccgggagauuuacaccgaagcucggaagccuggaaauuucuaccgaguccgaugacuucuaccagaaccagccuacacgguuuacccccgugggcaucgggguugaucacgaagcugacuuccaacaguggacgcugcccgauuacgccggacaguuuacacacaauaugaaccucgccccugcuguggccccgaauuuccccggcgagcagcugcuguuuuucagaagccaacuuccuucuagcggcgggcgcuccaacggaauccucgacugccuggucccccaggagugggugcagcauuuuuaucaggaaucugcuccuagccaaacccaggucgcccuugugcgguacguuaaucccgauaccggcagagugcuguucgaggcgaagcuccacaaacugggguuuaugacaauugccaagaacggagacuccccuaucaccgugcccccgaacggcuauuuccgcuucgaaagcugggucaauccuuuuuacacacuggcucccauggggacgggcaacggacggagacgcauucaguga

SEQ ID NO: 26754 - RNA, 1623 nt, Artificial Sequence
  derived and/or modified sequence opt5 from capsid_protein_VP1__Norovirus__AII02821
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacagucuacaccgggggagccccguuuacgccuaaacucggcuccgugcaguucagcacagacaccgaaaacgauuuugaggcccaucaaaauaccaaguucacacccguuggcgugauccaggacgggggaaccacacaccgcaacgaaccccagcaauggguccugccuuccuacucuggcagagaugugcacaauguucaucuugcuccggccguggcgcccacguuuccuggggagcagcuccuguucuuucggagcaccaugcccggauguuccggcuauccuaacauggaccuggauugccugcucccccaggaguggguccagcacuucuaccaagaagcugccccugcccagagcgacguggcucugcuucgcuuugugaaucccgauacagggagaguucuguucgaguguaaacuccauaagucuggcuaugucaccguggcccacacaggacagcacgaccuggugauuccgccuaacggcuacuuucgguucgauuccugggucaaccaguucuauacccuugcucccauggggaauggaacgggcagacgccgggcccuguga

SEQ ID NO: 26755 - RNA, 1623 nt, Artificial Sequence; identical to SEQ ID NO: 26475
  derived and/or modified sequence opt5 from capsid_protein_VP1__Norovirus__AII02824

SEQ ID NO: 26756 - RNA, 1623 nt, Artificial Sequence; identical to SEQ ID NO: 26475
  derived and/or modified sequence opt5 from capsid_protein_VP1__Norovirus__AII02827

SEQ ID NO: 26757 - RNA, 1623 nt, Artificial Sequence; identical to SEQ ID NO: 26475
  derived and/or modified sequence opt5 from capsid_protein_VP1__Norovirus__AII02830

SEQ ID NO: 26758 - RNA, 1623 nt, Artificial Sequence
  derived and/or modified sequence opt5 from capsid_protein_VP1__Norovirus__AII02833
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcggcgugacacauauugcuggguccagaaauuacaccaugaaccucgcgagccugaauuggaacaauuaugauccuaccgaagagauccccgccccucuuggaacacccgacuucgucggcaaaauucagggggugcugacgcagaccacaaagggagauggcucuacccgggggcacaaggcuacagucuacaccggauccgccccguuuacgccuaaacucggcagcgugcaguucuccacagacaccgaaaacgacuuugaggcccaucaaaauaccaaguucacacccguuggcgugauccaggaugggggaaccacacaccgcaacgaaccccagcaauggguccugccuucuuacagcggcagagacgugcacaauguucaucuugcuccggccguggcgcccacguuuccuggggagcagcuccuguucuuucgguccaccaugcccggauguagcggcuauccuaacauggaucuggacugccugcucccccaggaguggguccagcacuucuaccaagaagcugccccugcccagucugauguggcucugcuucgcuuugugaaucccgacacagggagaguucuguucgaguguaaacuccauaaguccggcuaugucaccguggcccacacaggacagcacgaucuggugauuccgccuaacggcuacuuucgguucgacagcugggucaaccaguucuauacccuugcucccauggggaauggaacgggcagacgccgggcccuguga

SEQ ID NO: 26759 - RNA, 1623 nt, Artificial Sequence
  derived and/or modified sequence opt5 from capsid_protein_VP1__Norovirus__AII02836
augaagauggccagcaacgacgcuaaucccuccgauggcucugccgcgaaccuggugccugaggucagcaaugaaguuauggcucucgagccgguggccggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaaauuaucuucgcugccgugccucccaauuuuccuacggagggacugucccccucucagguuaccauguucccgcauaucauuguggacgucagacaacucgagccugugcugaucccccugccugaugugcggaacaauuuuuaucacuacaaccagacaaaugacagcaccauuaagcucaucgcuaugcuguauacaccccuucgcgccaacaacgccggcgaagaugucuucaccguuuccugcagagugcugacacggcccagcccugacuuugauuucauuuuucucgugccgcccaccgucgagucucgcacgaaaccuuucaccgugcccauccugacaguugaagagaugaccaauuccagauuuccuauuccccuugagaagcuguucacagggccgagcggagcuuucgugguccagccucagaacggccgguguaccacggacggggugcuccugggaacaacccaacugucucccguuaauaucugcacauuucgcggcgaugugacccauaucgcgggcuccagaaacuacaccaugaaucucgccagccugaacuggaauaacuaugacccuacagaagagauucccgcuccucuugggacgcccgauuucgucggaaaaauccagggcgugcugacccagacaaccaagggggacggaucuacacggggccacaaggccaccgucuacacgggguccgccccguuuacaccuaaacucggaagcgugcaguucuccaccgacaccgaaaaugauuuugagacacaucaaaacaccaaguucacacccguuggcgugauucaggacggcgggacgacccaccgcaaugaaccccagcaauggguccugccuucuuacagcggaagagaugugcacaacguucaucuugcuccggccguggcgcccacauuuccuggcgagcagcuccuguucuuucgguccaccaugcccggguguagcggauauccuaauauggaccuggauugccugcucccccaggaguggguccagcacuucuaccaagaagcugccccugcccagucugacguggcucugcuucgcuuugugaaccccgauacaggcagaguucuguucgaguguaaacuccauaaguccggguaugucaccguggcccacacgggccagcacgaccuggugaucccgccuaauggauacuuucgguucgauagcugggucaaccaguucuauacccuugcucccaugggcaacgggacaggaagacgccgggcccuguga

SEQ ID NO: 26760 - RNA, 1623 nt, Artificial Sequence; identical to SEQ ID NO: 26549
  derived and/or modified sequence opt5 from capsid_protein_VP1__Norovirus__AII02839

SEQ ID NO: 26761 - RNA, 1623 nt, Artificial Sequence; identical to SEQ ID NO: 26557
  derived and/or modified sequence opt5 from capsid_protein_VP1__Norovirus__AII02842

SEQ ID NO: 26762 - RNA, 1647 nt, Artificial Sequence; identical to SEQ ID NO: 26693
  derived and/or modified sequence opt5 from capsid_protein_VP1__Norovirus__AII02845

SEQ ID NO: 26763 - RNA, 1647 nt, Artificial Sequence; identical to SEQ ID NO: 26693
  derived and/or modified sequence opt5 from capsid_protein_VP1__Norovirus__AII02848

SEQ ID NO: 26764 - RNA, 1623 nt, Artificial Sequence; identical to SEQ ID NO: 26508
  derived and/or modified sequence opt5 from capsid_protein_VP1__Norovirus__AII02851

SEQ ID NO: 26765 - RNA, 1623 nt, Artificial Sequence; identical to SEQ ID NO: 26475
  derived and/or modified sequence opt5 from capsid_protein_VP1__Norovirus__AII02854

SEQ ID NO: 26766 - RNA, 1623 nt, Artificial Sequence
  derived and/or modified sequence opt5 from capsid_protein_VP1__Norovirus__AII02857
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucaucguccagccucagaauggccgguguacaaccgacggggugcuccugggaacgacacaacugucucccguuaacaucugcaccuuucgcggcgaugugacacauauugcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacagucuacaccggguccgccccguuuacgccuaaacucggaagcgugcaguucuccacagacaccgaaaacgauuuugaggcccaucaaaauaccaaguucacacccguuggcgugauccaggacggcgggaccacacaccgcaacgaaccccagcaauggguccugccuucuuacagcggaagagaugugcacaauguucaucuugcuccggccguggcgcccacguuuccuggcgagcagcuccuguucuuucgguccaccaugcccggguguagcggauauccuaacauggaccuggauugccugcucccccaggaguggguccagcacuucuaccaagaagcugccccugcccagucugacguggcucugcuucgcuuugugaaucccgauacaggcagaguucuguucgaguguaaacuccauaagccgggguaugucaccguggcccacacaggccagcacgaccuggugauuccucccaacggauacuuucgguucgauuccugggucaaccaguucuauacccuugcuccuaugggcaaugggacgggaagacgccgggcccuguga

SEQ ID NO: 26767 - RNA, 1623 nt, Artificial Sequence; identical to SEQ ID NO: 26475
  derived and/or modified sequence opt5 from capsid_protein_VP1__Norovirus__AII02860

SEQ ID NO: 26768 - RNA, 1623 nt, Artificial Sequence; identical to SEQ ID NO: 26475
  derived and/or modified sequence opt5 from capsid_protein_VP1__Norovirus__AII02866

SEQ ID NO: 26769 - RNA, 1623 nt, Artificial Sequence
  derived and/or modified sequence opt5 from capsid_protein_VP1__Norovirus__AII02869
augaagauggccagcaacgacgcuaaucccaccgauggcuccgccgcgaaccuggugccugaggucucuaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagaccaaugacucuacaauuaagcucaucgccaugcuguauacaccccuucgcgcuaacaacgccggcgaagauguuuucaccgugagcugcagagugcugacccggcccuccccugacuuugauuucauuuuucucgucccgcccacgguggagagccgcaccaaaccuuucacaguucccauccugaccguggaagagaugacaaauucuagauuuccuauuccccuugagaagcuguucaccgggccguccggagccuucgucgugcagccucagaacggccgguguacgacagacgggguucuccugggaaccacacaacugagccccgugaauaucugcaccuuucgcggcgaugucacccauaucgcuggcucuagaaacuacacaaugaaucucgcgucccugaacuggaauaacuaugacccuacggaagagauucccgccccucuugggacccccgauuucgugggaaaaauccagggcguccugacacagaccacaaagggggacggaagcacccggggccacaaggcuacgguguacacagggucugccccguuuaccccuaaacucggauccguucaguucagcaccgacacagaaaaugauuuugagacccaucaaaacacaaaguucacgcccgugggcgucauucaggacggcgggaccacacaccgcaaugaaccccagcaaugggugcugccuuccuacucuggaagagauguucacaacgugcaucuugccccggcugucgcccccaccuuuccuggcgagcagcuccuguucuuucggagcacaaugcccggguguuccggauauccuaauauggaccuggauugccugcucccccaggagugggugcagcacuucuaccaagaagcggcuccugcccagagcgacguggcccugcuucgcuuuguuaaccccgauaccggcagaguccuguucgaguguaaacuccauaagucuggguaugugacgguggcucacaccggccagcacgaccuggucaucccgccuaauggauacuuucgguucgauuccugggugaaccaguucuauacacuugcccccaugggcaacgggaccggaagacgccgggcucuguga

SEQ ID NO: 26770 - RNA, 1623 nt, Artificial Sequence; identical to SEQ ID NO: 26475
  derived and/or modified sequence opt5 from capsid_protein_VP1__Norovirus__AII02872

SEQ ID NO: 26771 - RNA, 1623 nt, Artificial Sequence; identical to SEQ ID NO: 26475
  derived and/or modified sequence opt5 from capsid_protein_VP1__Norovirus__AII02875

SEQ ID NO: 26772 - RNA, 1647 nt, Artificial Sequence; identical to SEQ ID NO: 26693
  derived and/or modified sequence opt5 from capsid_protein_VP1__Norovirus__AII02878

SEQ ID NO: 26773 - RNA, 1623 nt, Artificial Sequence; identical to SEQ ID NO: 26475
  derived and/or modified sequence opt5 from capsid_protein_VP1__Norovirus__AII02881

SEQ ID NO: 26774 - RNA, 1623 nt, Artificial Sequence; identical to SEQ ID NO: 26475
  derived and/or modified sequence opt5 from capsid_protein_VP1__Norovirus__AII02884

SEQ ID NO: 26775 - RNA, 1647 nt, Artificial Sequence; identical to SEQ ID NO: 26693
  derived and/or modified sequence opt5 from capsid_protein_VP1__Norovirus__AII02887

SEQ ID NO: 26776 - RNA, 1623 nt, Artificial Sequence; identical to SEQ ID NO: 26557
  derived and/or modified sequence opt5 from capsid_protein_VP1__Norovirus__AII02890

SEQ ID NO: 26777 - RNA, 1623 nt, Artificial Sequence; identical to SEQ ID NO: 26510
  derived and/or modified sequence opt5 from capsid_protein_VP1__Norovirus__AII02893

SEQ ID NO: 26778 - RNA, 1623 nt, Artificial Sequence
  derived and/or modified sequence opt5 from capsid_protein_VP1__Norovirus__AII02896
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaauuaucuucgccgcuguuccucccaauuuuccuacggagggacugucccccucucaggugaccauguucccgcauaucauugucgacgugcggcagcucgagccugugcugaucccccugccugauguccgcaacaauuuuuaucacuacaaccaaacaaaugacagcaccauuaagcucaucgccaugcuguauacaccccuuagagcuaacaacgccggcgaagauguuuucaccguguccugccgggugcugacacgccccagcccugacuuugauuucauuuuucucgucccgcccaccguggagucuagaacgaaaccuuucaccguucccauccugacaguggaagagaugaccaauucccgguuuccuauuccccuugagaagcuguucacagggccgagcggagccuucgucgugcagccucagaacggccgcuguaccacggacgggguucuccugggaacaacccagcugucucccgugaauaucugcacauuuagaggcgaugucacccauaucgcuggcucccggaacuacaccaugaaucucgcgagccugaacuggaauaacuaugacccuacagaagagauucccgccccucuugggacgcccgauuucgugggaaaaauccaaggcguccugacccagacaaccaagggggacggaucuacacgcggccacaaggcuaccguguacacgggguccgccccguuuacaccuaaacucggaagcguucaguucuccaccgacaccgaaaaugauuuugagauucaucagaacacaaaguucacccccgugggcgucauccaagacggcgggacaacgcacagaaaugaaccccagcagugggugcugccuucuuacagcggacgggauguucacaacgugcaucuugccccggcugucgcccccaccuuuccuggcgagcaacuccuguucuuucgcuccacaaugcccggguguagcggauauccuaauauggaccuggauugccugcucccccaggagugggugcagcacuucuaccaggaagcggcuccugcccaaucugacguggcccugcuuagauuuguuaaccccgauaccggccggguccuguucgaguguaaacuccauagauccggguaugugacaguggcucacaccggccagcacgaccuggucauuccgccuaauggauacuuucgcuucgauagcugggugaaccaguucuauacgcuugcccccaugggcaacgggaccggacggagacgcgcucuguga

SEQ ID NO: 26779 - RNA, 1647 nt, Artificial Sequence
  derived and/or modified sequence opt5 from capsid_protein_VP1__Norovirus__AII02899
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaaccguucucccugcccauccucaccauuagcgaaaugucuaauuccagauuuccugugcccaucgacagccugcauacgucuccuaccgagaacaucgugguccagugccagaauggacgggugacacuggauggcgagcucauggggaccacacaacugcuucccucccagauuugugcguuccgcggaaugcugaccagaagcacgucccgggccucugaccaggcugauacagccaccccgcgccucuucaacuauuacuggcacauccagcuggacaaucuuaacggcacaccuuaugaccccgccgaagauauuccuggcccccuggggaccccugacuuuagaggaaagguuuucggcguggcuagccaacggaaucccgaugccaccacacgcgcgcaugaggcuaaaaucgacacgaccuccgggagauuuacaccgaagcucggaagccuggaaauuucuaccgaguccggcgauuucgaccagagccagccuacacgguuuacccccgucgggaucggaguggaucacgaagccgacuuccaacaguggacgcugcccgauuacgccggccaguuuacacacaacaugaaucucgcuccugccguugcuccgaacuuccccggcgagcagcugcuguuuuucagaucucaacuuccuagcuccgggggacgcucuaauggcauccucgacugccuggugccccaggaguggguccagcauuuuuaccaggaaagcgccccuucccaaacccagguggcgcuuguccgguaugugaaccccgauaccgggagaguucuguucgaggccaagcuccacaaacugggauuuaugacaauugcuaagagcggcgacucuccuaucaccgugcccccgaauggguacuuccgcuucgaauccugggucaacccuuuuuauacacuggcccccaugggcacgggaaacggccggagacgcauucaguga

SEQ ID NO: 26780 - RNA, 1623 nt, Artificial Sequence; identical to SEQ ID NO: 26475
  derived and/or modified sequence opt5 from capsid_protein_VP1__Norovirus__AII02902

SEQ ID NO: 26781 - RNA, 1647 nt, Artificial Sequence
  derived and/or modified sequence opt5 from capsid_protein_VP1__Norovirus__AIS24557
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaccgacaaucuguccgcugcccagauuacaaugugcccucaugucaucguggauguucgccaacuggagcccauuaaccucccgaugccugacgugagaaauaacuucuuucacuauaaccagggcucugauagccggcugcgccuuaucgccaugcuguacacaccccucagagcuaauaacuccggggacgaugucuucaccgugucuugucgggugcugacccgcccuagccccgacuuuuccuucaauuuucuuguucccccuacagucgaaagcaagaccaaaccguucacgcugcccauucucaccaucucugagauguccaacagcagauuuccugugcccauugauucucugcauacauccccuaccgacaauaucgugguccagugccagaacggacgggugacacuggauggcgaacucauggggaccacgcaacugcuucccagccagaucugugcguuccgcggaguucugacaagaucuaccucccgggccagcgaccaggcugacgccgccacaccgcgccucuucaauuauuacuggcacauucagcuggauaaccuuaauggcaccccuuaugaccccgcugaggauaucccugcgccccugggcaccccugacuuuagagggaagguguucggagucgccucccaacggaaccccgauucuacaacgcgcgcucaugaggccaaaguggacaccacaagcggcagauuuaccccgaagcucgggucccuggaaauuagcacagagucuggagauuucgaccagaaucagccuacccgguuuacgcccguuggcaucgggguggauaacgaagccgacuuccaacaguggacacugcccgauuacuccggacaguuuacccacaauaugaaccucgcuccugccgucgcuccgaauuuccccggcgagcagcugcuguuuuucagaagccaacuuccuucuagcggcgggcgcuccaacggaauccucgacugccuggugccccaggaauggguccagcacuuuuaccaggagucugccccugcgcaaacccagguggcccuuguucgguaugugaaccccgacacaggcagaguccuguucgaggcuaagcuccauaaacugggguacaugaccaucgccaagagcggagauuccccuaucacagugcccccgaauggcuauuuucgcuucgaaagcuggguuaacccuuucuacacgcuggcucccauggggaccggcaauggacggagacgcauucaguga

SEQ ID NO: 26782 - RNA, 1620 nt, Artificial Sequence
  derived and/or modified sequence opt5 from capsid_protein_VP1__Norovirus__AIY30135
augagaaugagcgacggcgccgcucccaaggccgauggguccgaggcgucuggacaggaccuggugccuaccgcugucgaacaagccguuccgauccagcccguggccggcgcugcccucgcugccccugcggccgggcagauuaaccagaucgaucccuggauuuuccaaaauuuugugcagugcccucugggagaguucagcaucagcccccggaacacaccuggcgaaauucuuuuugaccuggcucucgggccgggacugaaucccuaccuugcccaccugucugcuauguauacgggcugggucggcaacauggaggugcagcucguucuggccgggaaugcguucaccgccggaaaaguggucguggcucugguuccucccuacuuuccuaagggcagccucacaaccgcccagaucacauguuucccccaugugaugugcgauguccgcacccuggaaccgauccaacuuccucugcucgacgugagacgggugcuguggcacgcuacacaggaucaggaggaguccaugcgccuugucuguaugcuguauacgccccucagaaccaacucuccuggggacgaauccuuuguuguguccggacggcugcugagcaaacccgccgccgauuucaauuuuguguaccucacacccccuauugagcgcaccaucuauagaauggucgaccugccggugauucagccccggcuuugcacccaugcucgcuggccugcgcccguuuacggccugcucguggauccuucucugcccuccaacccgcaauggcagaaugggagaguccacguggacggaacacuucugggcaccacgccuguuagcggcucuuggguguccuguuucgccgcugaagccgccuaugaguuucagagcgggacaggacaagucgcuaccuucacacucaucgagcaggauggcucugccuacgugcccggggaccgggcggcuccucugggauaccccgacuuuuccggccagcuggaaauugagguccagaccgaaaccacaaagacgggggauaaacucaaggugaccacauucgagaugauccugggaccuaccacaaacguugaccaagcccccuaucagggcaagguguucgccagcauuaccgcugccgcuucccuugaucuggucgacggccgcgugagagccguuccgcggucuaucuacggguuucaggaugugaucccugaauauaaugacggacuccuggucccccuugcgcccccuauuggcccguuccugcccggggaggugcuccugcgcuuuagaacguacaugcggcagcuggauacagccgacgcugccgcugaggccaucgauugcgcgcucccucaagaguucauuagcugguuugccuccaacguguucaccguucagagcgaagcucugcuucugagauaucgcaauacccucacaggacagcugcuguuugaauguaaacuuuacucugagggcuauaucgcccucuccuacagcgggucuggcccccugaccuucccuacagacggauuuuucgaagucgugagcugggugccccggcuguaccagcucgcuuccgucggcucucuggccacggggagaacccuuuga

SEQ ID NO: 26783 - RNA, 1623 nt, Artificial Sequence
  derived and/or modified sequence opt5 from capsid_protein_VP1__Norovirus__AKE07100
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaauuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaagugaucuucgcggccguuccucccaauuuuccuaccgagggacugucccccucucaggugacaauguucccgcauaucgucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccauuccugugcugaccaucgaggaaaugacaaauagcagauuucccauuccgcuugagaagcuguucaccgggccuucuuccgccuucgucgugcagccccagaacggacgguguagcacagauggcguucuccuggggaccacgcaacugucuccugugaauaucugcacauuucgcggagacgucacccauaucgccggcucccacaacuacacaaugaaucucgcuagccagaacuggaacuccuaugaucccaccgaggaaauuccugcgccccugggcaccccggacuucguggggaaaauccagggaguccuuacacagacgaccagagccgacggcucuacacgggggcauaaggcuaccgugcugacaggaagcgccaauuuuaccccuaagcucggccgcauucaauucgccacggauacagacaaugauuuugagaccaaccagaauaccaaauucacacccguuggggugauccaggacggagauaccgcucacagaaacgaaccccaacaguggguccugccuuccuacagcggccggaauacacacaacgugcaucuugccccggcgguugcucccacguuuccuggcgagcagcuccuguucuuucgcucuaccauucccggguguuccggauacccuaauauggaccuggauugccugcucccccaggaaugggugcaauucuuuuaucaggaggccgccccugcucagagcgacgucgcccugcuuagauucgugaaccccgauacaggccgggugcuguuugaguguaagcuccacaaaucuggguacaucaccguugcucauacaggacagcacgaccuggucaucccgccuaacggcuauuucagauucgauagcugggugaaucaauuuuacacccuugcccccauggggaacggcacgggacgccggagagcgcuguga

SEQ ID NO: 26784 - RNA, 1623 nt, Artificial Sequence
  derived and/or modified sequence opt5 from capsid_protein_VP1__Norovirus__AKE07103
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagucccugucucccagccaggugaccauguucccgcauaucauugucgacgugagacaacucgagccugugcugaucccccugccugauguccggaacaauuuuuaucacuacaaccaguccaaugaccccacaauuaagcucaucgccaugcuguauacaccccuucgcgcuaacaacgccggagaugacguuuucaccgugagcugcagagugcugacccggccuucuccggauuuugacuucauuuuucucgugcccccuacagucgaaucccgcaccaaacccuucagcguuccuauccugacgguggaggaaaugaccaauucuagauuucccauuccgcuugagaagcuguucacaggcccuuccagcgccuucgucgugcagccccagaacgggcgguguaccaucgauggaguucuccugggcacaacccaacugucuccugugaauaucugcacguuucgcggggacgucacacauauugcuggaacccacaacuacacaaugaaucucgcgacccagaacuggaacuccuaugaucccaccgaggaaaucccugcuccccugggcacaccggacuucgugggcaaaauucaggggguccuuacgcagaccacaaagaccgacggaagcacaagaggccauaaggccaccguguguaucggguccgccgauuuugccccuaaacugggacggguucaauucgagacggacacaaauaaugaucucgaaaccaaccagaauaccaaguuuacacccgugggcgucauucagaacggggagaccgcucaccgcaaugaaccccaacagugggugcugccuucuuacagcggaagaaacacaccgaauguucaccuugcccccgcgguggcuccuacguuccccggcgagcagcugcucuuuuuccgguccaccaugccuggcugcagcggguaccccaacauggaccuggauugucugcucccucaggaguggguccaauauuuuuaccaggaagccgcccccgcucagucugacguggcccugcuucgcuucgugaacccggauacaggaagaguucuguuugagugcaaacuccauaaguccggcuaugucaccguggcucacacagggagccaugaccuggugaucccucccaauggauacuuccgguuugauucuugggucaaccaguucuauacccuugccccuaugggcaaugggacgggcagacgccgggcgaccuga

SEQ ID NO: 26785 - RNA, 1623 nt, Artificial Sequence
  derived and/or modified sequence opt5 from capsid_protein_VP1__Norovirus__AKE07106
augaagauggccagcuccgacgcuaaccccucugauggcagcaccgccaaucuggugccugaggucaacgacgaaguuauggcgcucgagccgguggugggggcugcccuggccgcucccgucgccggacagcaaaaugugaucgauccuuggauuagaaacaauuucguucaggcucccggcggggaauuuacaguguccccucggaacgcccccggagagauccuuuggucugcgccucugggcccggaccucaaucccuaccugagccaccuugcccgcauguauaacggguacgcuggaggcuucgaaguccaggugauucuggccggcaaugcuuuuacggccgggaaaguuaucuucgcggccgugccucccaacuuuccuaccgagggacucucccccucucaggucacaauguucccgcauauuaucguggaugugagacaacuggagccuguccugaucccccucccugacgcucggaauaacuuuuaucacuacaaucagagcaacgaauccaccauuaagcugaucgccaugcuuuauacaccccugcgcgcuaauaacgccggcgaugacguuuucaccgugagcugcagagugcucacacggcccucucuggauuuugacuucauuuuucuugucccuccgaccguggagucccgcacgaaacccuucagcguuccuauccugaccguggaagagaugacaaacucuagauuucccauuccucucgagcggcuguucaccgggcccuccagcgccuucgcuguccagccgcagaauggacgcuguacaaccgauggcgugcugcucgggacgacacaacugucuccuguuaacaucugcaccuuuagaggagacgugacacauaccaccggcucccacaauuacacaaugaaccuugcgagccagaaucgguccaacuaugaucccacggaagagauuccugcuccccugggcaccccugacuucgucgggaagauccagggagcccucacacagaccacacgcgccgacggcucuaccagagggcauaaagccacgguguacacaggaagcgcugauuuuacccccaagcugggccggguccaauucgccaccgacacagaucacgacuuugauaccaaucagaacacaaaguucacgccgguggggguuauccaggacggauccaccacacaccgcaaugaaccucaacagugggugcuucccagcuacucuggcagaaacacccauaauguccaccuggcgcccgcuguggccccuacauuuccgggcgagcagcuccuguucuuucgguccaccaugcccggguguagcggauauccuaacauggaucuggacugccuccugccccaggaauggguugcccauuucuaccaagaggcugccccugcucagucugauguggcccuucugagauuugucaaucccgacacgggccgcguucucuucgaguguaaacugcacaagagcggguaugugaccguggcgcacacaggacagcaugaucuugucauuccucccaacggcuacuuucgguucgacuccugggugaaucaguucuauacccuggccccgauggggaacggcacaggaagacgccgggcucucuga

SEQ ID NO: 26786 - RNA, 1719 nt, Artificial Sequence
  derived and/or modified sequence opt5 from capsid_protein_VP1__Norovirus__ALQ12260
augaagauggccagcaacggcgcugccgcgcccucccaggacggggcugccaaucuggugccugaaucucaacaggaaguccucgcccuggagccgguugcuggagccgcucuugccgcgcccguggccggccaguucaacgcuaucgauccuuggauuaaacagaauuuugugcaagcccccgcuggggaguucaccgucagcccuagaaacgcccccggagaagugcugauggaccucgaacugggcccugagaugaauccguuucuugcgcaccuggcccagauguacaacgcuuaugccgggggaauggagguucagaucauucucgcuggcaaugccuucacagccggcaagaucauugugugcgcugugcccccuaacuuucccccugaucggcuguccgcgucucaggccacgaauuucccccaugucaucauggacguucgcacccuggaaccggugguccucccucugcccgaugugagagcuggguuuuuccacuacaaccaacuucgggagccucgcaugagacugaugacacuccuguauacaccccuucgggccaauggaaccggcgacgaugccuuuaccgugagcugucgcguccugacaagacccaugcucgacuucgaauuuauguuccugguuccuccgaccguggagucccgggugacgcccuuuucugucccuaccuaccccgugguugagaugacaaacagccgcuggccugcuagaaucuccgggaugcaugugaaugccaaccagacccuggcgguccaguuccagaauggacggugcacacucgauggccaacugauggggaccacgcagcuuugugcugccgacgugugccgcaugagaggacgguauacaagcacccgcgccgaucccgcuggccugggcugggaccucgaugccacaacccugguugacgggccggaagcuagagugcaggcccggauuucugucuccgcgcaccuucaacuggaggaacucagcggacagccuuacgagguguauggcgaacagcccgccccucuggggacccccgacuuccaguguagacugaugggagagcucguccgccugccuucugcuaaccccguggcccaaucccgguuuagagaugcuuucuuugacacauacggcgcccuuuucgcgccggccguugggagcgugacggucaccgugaacaauucuuccagcuccgauuuugcuaacgaccagccuuucgaguuucugcccaucggaguugaaauuggcaauucugcccgcuacgaugaguucgcucuccccagcuauaacggcgccaucggggaaaaucggcaucuggccccuauugcugcgccgggauuucccggcgagaaccuuaucuucuuuuccagcaaucugccugugugggacucuacauccgcccagagcaacagacgcauuucuugccuccugcccaaugaguucauccagcacuuuuacgaucugcaagcuccuagccaguccgacgucgcccuccugcgguaugugcaccccgaaaccgauagauuccuuuucgaguguaaacuguaccgcgacgccuuucucacagugaacggggcuucuuaugccgaguucccuguuaauggauacagccgguuugauuccugggucaagcaguucuuuacccugagccccgugggcacggggucuggcagacgcggacgguccagaaaagcgcaguga

SEQ ID NO: 26787 - RNA, 1620 nt, Artificial Sequence
  derived and/or modified sequence opt5 from capsid_protein_VP1__Norovirus__BAI49904
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaagagcagauuuccuauuccccuugagaaacuguacaccgggccgucuuccgccuucgucgugcagccucagaacggacgguguacaaccgauggcguucuccuggggacgacacaacugagcguggucaauaucugcaccuuccgcggagacgugacacauaucgccggcucucacgauuauaccaugaaccucgcuucccagaauuggaacaauuacgaccccaccgaggaaauuccugcgccccugggcacaccugacuuugucgggaagauccagggaaugcuuacgcagaccacaagagaggauggcagcacccgggcccauaaggcuacaguguccaccgggucuguucacuucacgcccaaacugggaagcgugcaauacacaaccgacaccaacaaugauuuucagacaggccagaacaccaaguucacaccggucggggugauucaagacggaaauaaccaccagaaugaaccucagcaguggguucuccccaacuauuccggccgcacgggccauaaugugcaccuggcccccgccgucgcuccuaccuuuccgggggagcaacuucuguucuuuagaagcacaaugcccggauguucuggcuacccuaacaugaaccucgauugccugcugccccaggaaugggugcagcauuucuaucaggaggccgcgccugcucaauccgacguggcccuccugcgguuuguuaaucccgauaccgggcgcuuccuuuuugaguguaaacugcacaagagcggauacgucacaguggcccacaccggcccucaugaccucgugauucccccgaacggguauuucagauuugauucuugggucaaucaguucuacacgcuggcuccuaugggcaacggagccggccggagacgcgugcuuuga

SEQ ID NO: 26788 - RNA, 1623 nt, Artificial Sequence
  derived and/or modified sequence opt5 from capsid_protein_VP1__Norovirus__BAI49905
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuucuaccagaacauaccggaugaaccucgccucccagaauuggaacaauuaugaucccacggaggaaauuccugcuccccugggcaccccggacuucgugggcaaaauccaggggaugcuuacacagaccacaaagggagacggcagcacccgcgggcacaaggcgacggucuccacaggaucuguggauuuuaccccuaaacugggcagcguucaauucgccaccgacacagauaacgacuuugagaccgggcagaauacaagauucacgcccgugggagucauucaggauggcuccagcgcucaucggaacgaaccccaacagugggugcucccugacuacucuggccgcaccguucacaaugugcaccuggccccggccgucgcucccacauuuccuggggagcagcuucuguucuuuagauccaccaugcccggauguagcggcuacccuaacauggaucucgacugccugcugccccaggaaugggugcaacauuucuaucaggaggccgcgccugcucagucugauguggcccuccugcgguuuguuaaucccgacacagggagaguccuuuucgaguguaagcugcacaaaaccggauacgugacgguggcccauaccggccagcacgaucucgucaucccgccuaacggguauuuucgcuucgacagcugggugaaucaauucuacacacuggcucccaugggcaacggagccggccggagacgcgcucuuuga

SEQ ID NO: 26789 - RNA, 1623 nt, Artificial Sequence
  derived and/or modified sequence opt5 from capsid_protein_VP1__Norovirus__BAI49906
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccacggacauaaggcgacggucagcacaggcuccguggauuuuaccccuaaacuggggucuguucaauucgccaccgacacagauaacgacuuugagaccggacagaauacacgcuucacgcccgugggcgucauucaggauggcagcuccgcucacagaaacgaaccccaacagugggugcucccugacuacagcgggcggaccguucacaaugugcaucuggccccggccgucgcucccacauuuccuggagagcagcuucuguucuuucgcucuaccaugcccggcuguuccggguacccuaacauggaucucgacugccugcugccccaggaaugggugcaacacuucuaucaggaggccgcgccugcucagagcgauguggcccuccugagauuuguuaaucccgacacaggacggguccuuuucgaguguaagcugcauaaaaccggcuacgugacgguggcccacaccgggcagcacgaucucgucaucccgccuaacggcuauuuuagauucgacucuugggugaaucaauucuacacacuggcucccaugggaaacggcgccgggcgccggagagcucuuuga

SEQ ID NO: 26790 - RNA, 1623 nt, Artificial Sequence
  derived and/or modified sequence opt5 from capsid_protein_VP1__Norovirus__BAI49907
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaguccuuacacagaccacacgcggcgacggguccaccagaggacacaaggcgacggugagcacaggcuccguugauuuuaccccuaagcuggggucugugcaauucgccaccgacacagauaacgacuuugagaccggacagaauacacgguucacgcccgucggcgugauucaggauggcagcuccgcucaucgcaacgaaccccaacaguggguucucccugacuacagcgggagaaccgugcacaauguccaccuggccccggccguggcucccacauuuccuggagagcagcuucuguucuuucgguucaccaugcccggcuguucuggguacccuaacauggaucucgacugccugcugccccaggaaugggugcaacauuuuuaucaggaggccgcgccugcucaguccgauguugcccuccugagauucgucaaucccgacacaggacgcgugcuuuuugaguguaaacugcacaagaccggcuacgugacggucgcccauaccgggcagcacgaucucgugaucccgccuaacggcuauuuccgguucgacagcuggguuaaucaauuuuacacacuggcucccaugggaaacggcgccgggagacgccgggcucuuuga

SEQ ID NO: 26791 - RNA, 1623 nt, Artificial Sequence
  derived and/or modified sequence opt5 from capsid_protein_VP1__Norovirus__BAI49909
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcaccuauaauggguacgcuggaggcuucgaaguccaggugauccuugccggcaacgcuuuuacagccgggaaaauuaucuucgcggccguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgcuaugcuguauacaccccuucgcgccaacaacgcuggcgaugacguuuucaccguguccugcagagugcugacgcggcccagcccugauuuugacuucauuuuucucgucccgcccaccguggaaucucgcacaaaaccuuucuccguucccauccugaccguggaggaaaugacaaauagcagauuuccuauuccccuugagaagcuguucaccgggccgucuuccgccuucgucgugcagccucagaacggacgguguacgacagauggcguucuccuggggaccacacaacugagccccgugaauaucugcaccuuucgcggagacgucacccauaucgccggcacacagaacuacacgaugaaucucgcuucucagaacuggaauaacuaugauccuaccgaggaaauucccgcgccucugggcacacccgacuucguggggaaaauccagggaguccuuacccaaacaaccagacgggacggcuccacgcgcgggcacaaggccacagugagcaccggauccguucauuuuaccccgaagcugggcucugugcaguucagcacagauaccuccaaugacuuugagacagggcagaacacgagauucaccccugucggagugguucaagauggcagcacaacccaccagaaugaaccccagcagugggugcuccccaacuacucuggccgggacucccacaauguccaucuggcuccugccguggccccgacauuucccggggagcaacuucuguucuuucgcagcaccaugccuggauguucuggcuaccccaacaugaaucucgauugccugcugccucaggaaugggugcagcacuucuaucaggagagcgcucccgcccaauccgacguugcgcuccugagauuugucaacccugauacggggcgggugcuuuucgaguguaaacugcauaagucuggauacgugaccgucgcucacacaggccagcacgaccucgugauucccccgaacggguauuuuagauucgauagcuggguuaaucaguucuacacccuggccccuaugggcaacggagccggccgccggagagcucuuuga

SEQ ID NO: 26792 - RNA, 1623 nt, Artificial Sequence
  derived and/or modified sequence opt5 from capsid_protein_VP1__Norovirus__BAI49910
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaagacgggacggcuccacccgcgggcacaaggccacggugagcacaggauccguucauuuuaccccgaagcugggcucugugcaguucagcaccgauacauccaaugacuuugagaccgggcagaacacaagauucacgccugucggagugguucaagauggcagcaccacacaccagaaugaaccccagcagugggugcuccccaacuacucuggccgggacucccacaauguccaucuggcuccugccguggccccgaccuuucccggggagcaacuucuguucuuucgcagcacaaugccuggauguucuggcuaccccaacaugaaucucgauugccugcugccucaggaaugggugcagcacuucuaucaggagagcgcucccgcccaauccgacguugcgcuccugagauuugucaacccugauaccgggcgggugcuuuucgagugugaacugcauaaaucuggauacgugacggucgcucacaccggccagcacgaccucgugauucccccgaacggguauuuuagauucgauagcuggguuaaucaguucuacacacuggccccuaugggcaacggagccggccgccggagagcucuuuga

SEQ ID NO: 26793 - RNA, 1623 nt, Artificial Sequence
  derived and/or modified sequence opt5 from capsid_protein_VP1__Norovirus__BAI49911
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacacgcggcgacgggcugaccagaggacacaaggcgacggucuccacaggcagcguggauuuuaccccuaagcucggguccguucaauucgccaccgacacagauaacgacuuugagaccggacagaauacacgguucacgcccgugggcgucauucaggauggcucuagcgcucaucgcaacgaaccccaacagugggugcugccugacuacuccgggagaaccguucacaaugugcaccuugccccggccgucgcucccacauuuccuggagagcagcuccuguucuuucggagcaccaugcccggcuguucuggguacccuaacauggaucuggacugccugcucccccaggaaugggugcaacauuucuaucaggaggccgcgccugcucaguccgauguggcccugcuuagauuuguugaccccgauacaggacgcguccuguucgaguguaaacuccacaagaccggcuacgugacgguggcccauaccgggcagcacgaccuggucaucccgccuaauggcuauuuucgguucgacagcugggugaaccaauucuacacacuugcucccaugggaaauggcgccgggagacgccgggcucuguga

SEQ ID NO: 26794 - RNA, 1623 nt, Artificial Sequence
  derived and/or modified sequence opt5 from capsid_protein_VP1__Norovirus__BAI49912
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggcgcauccagggaaugcuuacacagaccacaaaaggcgacggguccaccagaggacacaaggcgacggucagcacaggcuccguggauuuuaccccuaagcuggggucuguucaauucgccaccgacacagauaacgacuuugagaccggacagaauacacgguucacgcccgugggcgucauucaggauggcagcuccgcucuccgcaacgaaccccaacagugggugcugccugacuacagcgggagaaccguucauaaugugcaccuugccccggccgucgcucugacauuucccggagagcagcuccuguucuuucggucuaccaugccuggcuguuccggguaccccaacauggaucuggacugccuccugccucaggaaugggugcaacacuucuaucaggaggccgcgcccagccagucugauguggcccuucugagauuuguuaauccugacacaggacgcguccucuucgaguguaaacugcaucgggcuggcuacgugaccguggcccacacggggcagcaugaucuugucauucccccgaacggcuauuuuagauucgacagcugggugaaucaauucuacacccuggcuccuaugggaaacggcgccgggcgccggagagcucucuga

SEQ ID NO: 26795 - RNA, 1623 nt, Artificial Sequence
  derived and/or modified sequence opt5 from capsid_protein_VP1__Norovirus__BAI49914
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccacccaucggaacgaaccccaacagugggugcucccugacuacagcgggcgcacaguucacaaugugcaccuggcuccggccgucgcccccaccuuuccuggagagcagcuucuguucuuuagaucuacaaugcccggcuguuccggguacccuaacauggaucucgacugccugcugccccaggaaugggugcaacauuucuaucaggaggcugccccuagccagucugauguggcgcuccugcgguuuguuaaucccgacaccggaagaguccuuuucgaguguaagcugcacaaagcuggcuacgugacgguggcccauaccgggcagcacgaucucgucaucccgccuaacggcuauuuucgcuucgacagcugggugaaucaauucuacacacuggcccccaugggaaacggcgcugggcggagacgcgcccuuuga

SEQ ID NO: 26796 - RNA, 1623 nt, Artificial Sequence
  derived and/or modified sequence opt5 from capsid_protein_VP1__Norovirus__BAI49916
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggccugcucacgcagaccacaaagggggacggaucuacccggggccacaaggcuacagucuacaccggguccgccccguuuacgccuaaacugggaggcgugcaguucagcacagacaccgaaaacgauuuugagacccaucaaaauacaaaguucacccccguuggcgugauucaggacggguccacaacgcaccgcaacgaaccccagcaauggguccuuccuucuuacagcggaagaaaugugcacaacguucaucuggccccggcuguggcccccaccuuuccuggcgagcagcuccuguucuuucgguccacaaugcccggguguagcggauauccuaauauggaucuggacugccuccugccccaggaguggguccagcacuucuaccaagaagcggcuccugcccagucugauguggcccuucugcgcuuugugaaccccgacaccggcagaguucucuucgaguguaaacugcauaaguccggguaugucacaguggcucacaccggccagcacgaucuugugaucccgccuaacggauacuuucgguucgacagcugggucaaucaguucuauacgcuggcccccaugggcaacgggaccggaagacgccgggcucucuga

SEQ ID NO: 26797 - RNA, 1623 nt, Artificial Sequence
  derived and/or modified sequence opt5 from capsid_protein_VP1__Norovirus__BAI49917
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagaggucacaaacuccagauuuccuauuccccuugagaagcuguucaccgggccgagcggagccuucgugguucagccucagaauggccgguguacaaccgacggggugcuccugggaacgacacaacugucucccgucaacaucugcaccuuucgcggcgaugugacacauaucgcuggcaccagaaauuacaccaugaaccucgcgucccugaauuggaacaauuaugacccuacagaagagauucccgccccucuugggacgcccgauuucgucggaaaaauccagggcgugcugacccagacaaccaagggggacggaagcacacggggccacaaggcuaccguuuacacggggucugccccguuuacaccuaaacucggauccgugcaguucagcaccgacaccgaaaacgauuuugagacacaucaaaauaccaaguucacacccgucggcgugauucaggacggcgggacgacccaccgcaacgaaccccagcaauggguucugccuuccuacucuggaagaaaugugcacaacguccaucuugccccggcuguggcccccacauuuccuggcgagcagcuccuguucuuucggagcaccaugcccggguguuccggauauccuaauauggaucuggacugccugcucccccaggagugggugcagcacuucuaccaagaagcggcuccugcccagagcgauguugcccugaugcgcuuugucaaccccgacacaggcagagugcuuuucgaguguaaacugcauaagucuggguaugugaccgucgcucacacgggccagcacgaucucgugaucccgccuaacggauacuuucgguucgacuccuggguuaaucaguucuauacccuggcccccaugggcaacgggacaggaagacgccgggcucuuuga

SEQ ID NO: 26798 - RNA, 1623 nt, Artificial Sequence
  derived and/or modified sequence opt5 from capsid_protein_VP1__Norovirus__BAI49918
augaagauggccagcaacgacgcuaaucccuccgauggcucugccgcgaaccuggugccugaggucaauaacgaaguuauggcucucgagccgguggccggggccgcuaucgccgcucccguggccggacagcaaaaugucauugacccuuggaucagaaacaauuucgugcaggcgcccggcggggaauuuaccguuagcccucggaacgcccccggagagauucugugguccgcuccucuuggcccggaucugaaucccuaccucucucaccuggcccgcauguauaacggguacgcuggaggcuucgaagugcaggucauccuugccggcaaugcguuuacagccgggaaaauuaucuucgcugccgugccucccaacuuuccuacggagggacugagccccucccagguuaccauguucccgcauaucauuguggacgucagacaacucgagccugugcugaucccccugccugaugugcggaauaacuuuuaucacuacaaucagucuaacgacagcacaauuaagcucaucgcuaugcuguauacaccccuucgcgccaacaaugccggcgaagaugucuucaccguuuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcggagcuuucgugguccagccucagaauggccgguguacaaccgacggggugcuccugggaacgacacaacugucucccguuaacaucugcaccuuucgcggcgaugugacacauaucgcgggcaccagaaauuacaccaugaaccucgccucccugaauuggaacaauuaugacccuacagaagagauucccgcuccucuugggacgcccgauuucgucggaaaaauccagggcgugcugacccagacaaccaagggggacggaagcacacggggccacaaggccaccgucuacacggggucugccccguuuacaccuaaacucggauccgugcaguucagcaccgacaccgaaaacgauuuugagacacaucaaaauaccaaguucacacccguuggcgugauucaggacggcgggacgacccaccgcaacgaaccccagcaauggguccugccuuccuacucuggaagaaaugugcacaacguucaucuugcuccggccguggcgcccacauuuccuggcgagcagcuccuguucuuucggagcaccaugcccggguguuccggauauccuaauauggaucuggacugccugcucccccaggaguggguccagcacuucuaccaagaagcugccccugcccagagcgauguggcucugaugcgcuuugugaaccccgacacaggcagaguucuuuucgaguguaaacugcauaagucuggguaugucaccguggcccacacgggccagcacgaucucgugaucccgccuaacggauacuuucgguucgacuccugggucaaucaguucuauacccuggcucccaugggcaacgggacaggaagacgccgggcccuuuga

SEQ ID NO: 26799 - RNA, 1623 nt, Artificial Sequence
  derived and/or modified sequence opt5 from capsid_protein_VP1__Norovirus__BAI49919
augaagauggccagcaacgacgcuaaucccuccgauggcucugccgcgaaccuggugccugaggucaauaacgaaguuauggcucucgagccgguggugggggccgccaucgcugcccccgucgcuggacagcaaaauauuaucgacccuuggauuagaaacaauuucgugcaggcccccggcggggaauuuaccguuagcccucggaacgcgcccggagagauccugugguccgccccucuuggcccggaucugaaucccuaccucucucaccuggcucgcauguauaacggguacgccggaggcuucgaagugcaggucauucuugcuggcaaugccuuuacagcggggaaaaucaucuucgccgcugugccucccaacuuuccuacggagggacugagccccucccagguuaccauguucccgcauauuaucguggacgucagacaacucgagccugugcugauuccccugccugaugugcggaauaacuuuuaucacuacaaucagucuaacgacagcacaaucaagcucauugccaugcuguauacaccccuucgcgcuaacaaugccggcgaagaugucuucaccguuuccugcagagugcugacccggcccagcccugacuuugauuucaucuuucucgugccgcccacagucgagucucgcaccaaaccuuucacggugcccauucugaccguugaagagaugacaaacuccagauuuccuaucccccuugagaagcuguucaccgggccgagcggagccuucgugguccagccucagaauggccgguguacaaccgacggggugcuccugggaacgacacaacugucucccguuaacaucugcaccuuucgcggcgaugugacacauauugcuggcaccagaaauuacaccaugaaccucgcgucccugaauuggaacaauuaugacccuacagaagagauccccgccccucuugggacgcccgauuucgucggaaaaauucagggcgugcugacccagacaaccaagggggacggaagcacacggggccacaaggcuaccgucuacacggggucugccccguuuacaccuaaacucggauccgugcaguucagcaccgacaccgaaaacgauuuugagacacaucaaaauaccaaguucacacccguuggcgugauccaggacggcgggacgacccaccgcaacgaaccccagcaauggguccugccuuccuacucuggaagaaaugugcacaacguucaucuugccccggcuguggcccccacauuuccuggcgagcagcuccuguucuuucggagcaccaugcccggguguuccggauauccuaauauggaucuggacugccugcucccccaggaguggguccagcacuucuaccaagaagcggcuccugcccagagcgauguggcccugaugcgcuuugugaaccccgacacaggcagaguucuuuucgaguguaaacugcauaagucuggguaugucaccguggcucacacgggccagcacgaucucgugauuccgccuaacggauacuuucgguucgacuccugggucaaucaguucuauacccuggcccccaugggcaacgggacaggaagacgccgggcucuuuga

SEQ ID NO: 26800 - RNA, 1623 nt, Artificial Sequence
  derived and/or modified sequence opt5 from capsid_protein_VP1__Norovirus__BAI49920
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagcucaacgacucuacaauuaagcugaucgccaugcuuuauacaccccugcgcgcuaacaaugccggcgaagauguuuucaccgugagcugcagagugcucacccggcccuccccugacuuugauuucauuuuucuggucccgcccacaguggagagccgcaccaaaccuuucacgguucccauccuuaccguggaagagaugacaaacucuagauuuccuauuccccuggagaaacucuucaccgggccguccggagccuucgucgugcagccucagaauggccgguguacaaccgacgggguucugcugggaacgacacaacucagccccgugaacaucugcaccuuucgcggcgaugucacacauaucgcuggcucuagaaauuacaccaugaaccuggcgucccuuaauuggaacaauuaugacccuaccgaagagauucccgccccucuggggacacccggauucgugggcaagauccaggggguccucacgcagaccacaaagggagauggcagcacccgggggcacaaggcuacaguguacaccggaucugccccguuuacgccuaaacugggcuccguucaguucagcacagacaccgaaaacgacuuugagacccaucaaaauacaaaguucacccccgugggcgucauucaggauggguccacaacgcaccgcaacgaaccccagcaaugggugcuuccuucuuacagcggaagaaauguucacaacgugcaucuggccccggcugucgcccccaccuuuccuggcgagcagcuccuguucuuucgguccacaaugcccggguguagcggauauccuaauauggaccuggauugccuccugccccaggagugggugcagcacuucuaccaagaagcggcuccugcccagucugacguggcccuucugcgcuuuguuaaccccgauaccggcagaguccucuucgaguguaaacugcauaaguccggguaugugacaguggcucacaccggccagcacgaccuugucaucccgccuaacggauacuuucgguucgauagcugggugaaucaguucuauacgcuggcccccaugggcaacgggaccggaagacgccgggcucucuga

SEQ ID NO: 26801 - RNA, 1623 nt, Artificial Sequence
  derived and/or modified sequence opt5 from capsid_protein_VP1__Norovirus__BAI49921
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauuaucgacgucagacaacucgagccugugcugauuccccugccugaugugcggaacaauuuuuaucacuacaaccagagcaaugacuccacaaucaagcucauugccaugcuguauacaccccuucgcgcuaacaacgccggcgaagaugucuucaccguuagcugcagagugcugacccggcccucucucgacuuugauuucaucuuucuggugccuccgacagucgagucccgcaccaaacccuucacggugccuauucuuaccguugaagagaugacaaauagcagauuucccaucccucuggagaaacucuucaccgggcccucuggagccuucgugguccagccgcagaacggccgguguacaaccgacggggugcugcugggaacgacacaacucuccccuguuaauaucugcacccugcgcggcgaugugacacauauugcuggcagcagaaacuacaccaugaaucuugcgucucugaacuggaauaacuaugaccccaccgaagagaucccugcuccccucgggacaccugauuuugucggaaagauucagggcgugcugacgcagaccacaaagggggacggauccacccggggccacaaggccacagucuacaccgggagcgcccccuucacgccgaaacuuggauccgugcaguuuucuacagacaccgaaaaugauuucgagacccaucaaaacacaaaguuuaccccuguuggcgugauccaggacggcagcacaacgcaccgcaaugaaccccagcaauggguccugcccuccuacagcgggagaaacgugcacaauguucaucucgccccugcuguggccccgaccuuccccggagagcagcugcuguuuuuccggucuacaaugccuggcuguuccggguaucccaacauggaucucgacugccugcuuccucaggaguggguccagcacuuuuaccaagaagcggcucccgcccagagcgauguggcccugcuccgcuucgugaauccugacaccggaagaguucuguuugaguguaaacuucauaagucuggcuaugucacaguggcucacaccgggcagcacgaucuggugauucccccgaacggcuacuuccgguuugacagcugggucaaccaguucuauacgcucgccccuaugggaaauggcaccgggagacgccgggcucuguga

SEQ ID NO: 26802 - RNA, 1623 nt, Artificial Sequence
  derived and/or modified sequence opt5 from capsid_protein_VP1__Norovirus__BAI49923
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugagacacaucagaauaccaaguucacacccgugggcgucauucaagacggcucuacgacccaccgcaacgaaccccagcagugggugcugccuagcuacuccgggagaaauguucacaacgugcaucuugccccggcugucgcccccacauuuccuggagagcaacuccuguucuuucggagcaccaugcccggcuguucuggguauccuaauauggaucuggacugccugcucccccaggagugggugcagcacuucuaccaggaagcggcuccugcccaauccgauguggcccugcuucgcuuuguuaaccccgacacaggaagaguccuguucgaguguaaacuccauaagagcggcuaugugaccguggcucacacggggcagcacgaucuggucaucccgccuaacggcuacuuucgguucgacucuugggugaaucaguucuauacccuugcccccaugggaaacggcacagggagacgccgggcucuguga

SEQ ID NO: 26803 - RNA, 1623 nt, Artificial Sequence
  derived and/or modified sequence opt5 from capsid_protein_VP1__Norovirus__BAI49924
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacauuaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauacccgcuucacacccgugggagucauccaggacggcggcaccacacacagaaacgaaccccagcaaugggugcugccuagcuacuccgggcggaauguuccgaacgugcaccuugcccccgcugucgccccuacguuucccggagagcagcuccuguucuuucgcagcaccaugccuggcuguucuggguaucccaauauggaucuggacugccugcucccucaggagugggugcagcauuucuaccaagaagcggcucccgcccaguccgauguggcccugcuuagauuuguuaacccggacacaggacggguccuguucgaguguaagcuccacaaaagcggcuaugugaccguggcucauacagggcagcacgaucuggucauuccucccaacggcuacuuuagauucgacucuugggugaaucaguucuauacccuugccccuaugggaaacggcacggggcgccggagaguucuguga

SEQ ID NO: 26804 - RNA, 1623 nt, Artificial Sequence
  derived and/or modified sequence opt5 from capsid_protein_VP1__Norovirus__BAI49925
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucgguccgcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacacgcuucacccccgugggagucauucaggacggcggcacaacgcacagaaaugaaccccagcaaugggugcugccuuccuacagcgggcggaacguuccgaaugugcaccuugcccccgcugucgccccuaccuuucccggagagcagcuccuguucuuucgcucuacaaugccuggcuguuccggguaucccaacauggaucuggacugccugcucccucaggagugggugcagcauuucuaccaagaagcggcucccgcccagagcgauguggcccugcuuagauuuguuaauccggacaccggacggguccuguucgaguguaagcuccacaaaucuggcuaugugacaguggcucauaccgggcagcacgaucuggucaucccucccaacggcuacuuuagauucgacagcugggugaaccaguucuauacgcuugccccuaugggaaauggcaccgggcgccggagaguucuguga

SEQ ID NO: 26805 - RNA, 1623 nt, Artificial Sequence
  derived and/or modified sequence opt5 from capsid_protein_VP1__Norovirus__BAI49926
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucaccagccugaauuggaacaauuaugacccuacagaagagauucccgcgccucuugggacgcccgauuucgugggaaaaauccagggccugcucacccagacaaccaagggggacggaucuacacggggccacaaggccaccgucuacacgggguccgcuccguuuacaccuaaacugggaagcgugcaguucuccaccgacaccgaaaacgauuuugagacacaucaaaauaccaaguucacacccguuggcgugauucaggacggcucuacgacccaccgcaacgaaccccagcaauggguccuuccuagcuacuccgggaucaaugugcacaacguucaucuggccccggccguggcucccacauuuccuggagagcagcuccuguucuuuagaagcaccaugcccggcuguucuggguauccuaauauggaucuggacugccuccugccccaggaguggguccagcacuucuaccaagaagccgcgccugcucaguccgauguggcccuucugcgguuugugaaccccgacacaggacgcguucucuucgaguguaaacugcauaagagcggcuaugucaccguggcccacacggggcagcacgaucuugugauuccgccuaacggcuacuuuagauucgacucuugggucaaucaguucuauacccuggcucccaugggaaacggcacagggcggagacgcgcccucuga

SEQ ID NO: 26806 - RNA, 1623 nt, Artificial Sequence
  derived and/or modified sequence opt5 from capsid_protein_VP1__Norovirus__BAI49927
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugagacacaucagaauaccaaguucacacccgugggcgucauucaagacggcgggacgacccaccgcaacgaaccccagcagugggugcugccuucuuacagcggaagaaauguucacaacgugcaucuugccccggcugucgcccccacauuuccuggcgagcaacuccuguucuuucgguccaccaugcccggguguagcggauauccuaauauggaucuggacugccugcucccccaggagugggugcagcacuucuaccaggaagcggcuccugcccaaucugauguggcccugcuucgcuuuguuaaccccgacacaggcagaguccuguucgaguguaaacuccauaaguccggguaugugaccguggcucacacgggccagcacgaucuggucaucccgccuaacggauacuuucgguucgacagcugggugaaucaguucuauacccuugcccccaugggcaacgggacaggaagacgccgggcucuguga

SEQ ID NO: 26807 - RNA, 1623 nt, Artificial Sequence
  derived and/or modified sequence opt5 from capsid_protein_VP1__Norovirus__BAI49928
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugaucgacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuucuuauuccucuggagaaacucuucacagggcccagcggagccuucgucgugcagccgcagaauggccgguguaccacggacgggguucugcugggaacaacccagcucucuccugugaacaucugcacauuucgcggcgaugucacccauaucgcuggcuccagaaauuacaccaugaaccuggcgagccuuaauuggaacaauuaugaccccacagaagagauuccugcuccccuggggacgccugauuucgugggaaagauccaaggcguccucacccagacaaccaagggggacggaucuacacggggccacaaggccaccguguacacgggguccgcccccuuuacaccgaaacugggaagcguucaguucuccaccgacaccgaaaacgauuuugagacacaucagaauaccaaguucacaccugugggcgucauucaagacggcucuacgacccaccgcaacgaaccccagcagugggugcuucccagcuacuccgggagaaauguucacaacgugcaucuggccccugcugucgccccgacauuucccggagagcaacuccuguucuuucggagcaccaugccuggcuguucuggguaucccaauauggaucuggacugccuccugccucaggagugggugcagcacuucuaccaggaagcggcucccgcccaauccgauguggcccuucugcgcuuuguuaacccugacacaggaagaguccucuucgaguguaaacugcauaagagcggcuaugugaccguggcucacacggggcagcacgaucuugucauucccccgaacggcuacuuucgguucgacucuugggugaaucaguucuauacccuggccccuaugggaaacggcacagggagacgccgggcucucuga

SEQ ID NO: 26808 - RNA, 1620 nt, Artificial Sequence
  derived and/or modified sequence opt5 from capsid_protein_VP1__Norovirus__BAJ25070
augaagauggccagcuccgacgcugcccccucuaacgauggcgcgaccgggcuggugccugagaucaauacagaaacgcucccgcuggagcccgucgcuggagccgccauugcugccccuguuaccggccagaacaauaucauugaccccuggaucagaaacaauuucgugcaagcuccuaacggggaauuuacagugagcccccgcaauuccccuggagagauucuuaugaaccuggaacucggcccggaucugaaucccuaccuugcccaccugucucggauguauaacggguacgcgggaggcgucgaggugcagguucuccuggccggcaaugcuuucaccgccgggaaaauccuguuugcugccgugccucccaacuucccugucgacaugcucagccccgcgcagaucacaaugcugccgcaucuuauuguggauguuagaacccuggagccuaucaugauuccccucccugacgugcggaaugucuuuuaucacuacaacaaucagcccgcgccccgcaugagacugguggcuaugcuuuauacaccucugcgguccaacggaucuggcgaagauguguucaccgucagcugccgcguucucacgagaccgacccccgacuuugaguucacauaccuggugccucccuccguggaaagcaagaccaaaccuuuuucucugcccauccucacaauuggggagcugaccaacucccgguucccggccccuaucgaucaacuuuuuacgagcacaaauaacgacgucgugguucagccccagaauggacgcuguacccuggauggcgagcuccaggggacaacccaacugcuuucuaccgcuauuugcuccuauagaggaacaacgagcaacccuaucgacgauugggacgaccaucugcuccaccugacccaucccaauggcgccacauacgauccuaccgaagacgugcccgccccguucggcacacaggauuuucaggggauccuguacggaaugcucacccagaacccucaaacgggcgggggagaggcugccaauucucggggcgucuauauuuccagcacauccgacaaguucacccccaaacuggggaccaucggacuucaccacgugcagggcggcgauguugccaacaaucagaagucuaaguucacacccauugggaucgcugaaaacggaaauaccccuuuucgccaaugggugcugccgaacuacagcggcagacucacacugaauacgaaccuugcccccgccgucgggccuaauuuccccggagagcagauucuguuuuuccgguccaacgugccuagcguccagggcgggcauucuaucgaaaucgacugucucauuccccaggaguggaucucccacuuuuaucaagagagcgcuccuucucagagcgauguggcccugauucgcuacguuaaccccgacaccggcagaacacuguucgaagcgaaacuccaucggcagggauuuaucaccauugcuacaaccggcaauaacccgguggucgugccucccaauggguauuucagauuugauuccuggguuaaccaguucuacgcccuggccccuaugggaacgggcaaugggcgccggagagugcaauga

SEQ ID NO: 26809 - RNA, 1620 nt, Artificial Sequence
  derived and/or modified sequence opt5 from capsid_protein_VP1__Norovirus__BAJ25072
augaagauggccagcaacgacgcugcccccuccaaugauggcgcgaccgggcuggugccugagaucaacacagaaacgcucccgcuggagcccgucgcuggagccgccauugcugccccuguuaccggccagaauaacaucauugaccccuggaucagaacaaauuucgugcaagcuccuaacggggaauuuaccgugucuccccggaauagcccuggagagauucuuaugaaccuggaacucggcccggaucugaaucccuaccuugcccaccuggcgcgcauguauaacggguacgccggaggcgucgaggugcagguucuccuggcuggcaaugccuucacagcugggaaaauccuguuugccgcggugccucccaacuucccugucgacaugcucucccccgcccagaucaccaugcugccgcaucuuauuguggauguuagaacacuggagccuaucaugauuccccucccugacgugcggaaugucuuuuaucacuacaacaaucagcccgcuccccgcaugagacugguggccaugcuuuauaccccucugcggucuaacggaagcggcgaagauguguucacggucuccugccgcguucucaccagaccgacacccgacuuugaguucaccuaccuggugccucccucuguggaaagcaagacaaaaccuuuuucccugcccauccucaccauuggggagcugacgaacagccgguucccggcuccuaucgaucaacuuuuuacaucuaccaauaacgacgucgugguucagccccagaauggacgcuguacacuggauggcgagcuccaggggaccacccaacugcuuuccacagccgugugcagcuauagaggaacgaccucuaacccuauugacgauugggacgaccaucugcuccaccugacacaucccaauggcgccaccuacgauccuacagaagacguccccgcuccguucggcacccaggauuuucaggggauccuguacggaaugcucacgcagaacccucaagcgggcgggggagaggccgcuuccagccggggcguguauaucucuuccacaagcgacaaguucacccccaaacuggggaccauuggacuucaccgcguucagggcggcgccguggccgauaaucagaaguccaaguucacacccaucgggauugcugaaaacgacaauaccccuuuuagacaauggguccugccgaacuacucuggacggcucacacugaauacgaaccuugcccccgcggugggcccuaauuuccccggggagcagauccuguuuuuccgcagcaacgucccuuccgugcagggaggccacagcauugaaaucgauugucucaucccccaggaguggguuucucauuuuuaucaagaguccgcuccuagccagucugacguggcccugauuagauacgucaaucccgauaccgggcggacacuguucgaagccaaacuccacagacagggcuuuaucaccauugcuacaaccggaaacaacccggugguugugccucccaauggcuauuuccgcuuugacagcugggucaaccaguucuacgcccuggcuccuauggggacgggaaauggccggagacgcgugcaauga

SEQ ID NO: 26810 - RNA, 1608 nt, Artificial Sequence
  derived and/or modified sequence opt5 from capsid_protein_VP1__Norovirus__BAJ25076
augaagauggccagcaacgacgcuaaucccuccucugauggcagcgccaaccuggugccugagaucuccaaugaagucauggcgcucgagccgguugcuggggccgccauugcugcccccguggcuggacagcaaaacaucauugacccuuggaucagaaauaacuucgugcaggcccccggcggggaauuuaccgucucuccucggaaugcgcccggagaggugcugcuuaaccugccucucagcccggauauuaaucccuaccuggcccaccuuucccgcauguauaacggcuacgcugggggaguugaaguggaggucgugcuggccggcaaugcuuucacagccggcaaaaucaucuuugcggccguuccucccaacuucccucccgagaaucucucuccgagccagauuacgaugcugccucauaucauuguggacgucagacagcuggaacccgugcggaucccucuccccgaugugcgcaacaauuuuuaucacuacuccagagagaacgacagcacccugcggcuuauugcuaugcuguauacaccccuccgcgccaacaaugcuggggaugacgucuucaccguuucuugcagagugcugacacggccuuccccggauuuugacuucaucuuucuugugcccccuaccgucgaaagcaagucuaaacccuucacaauuccuaugcugaccaucgaggagaugacgaacucccgcuuucccgccccgcucgaacugaugaccacaggaccuagccaugauaucgugguucaaccccagaauggcagauguaccauugacggggugcugcucggaacaacccagcugucuccugucaacaucugcucccuucggggcgugcccacgaagcgcacaaaugggaacgauaauuguuucguucagcuggagaacccuaauggaagcgccuacgaccccaccgaagacauuccggcugugcucggcuccccugauuuugucggcgagcuguaugggacaaucacccaaagaucuagcgacaacuccacccgggcgcaccccuucacacuuaauacgggaagcccccgcuacaccccuaaaauuggcucuguggauaucagagucacagacguguccgaucugcaggaccaugauccgguuaagcucacccccguggggcugagcggagaccggggcucuauccaccaguggcagcugccuaacuacagcggggucgccacacacaauaugcaucucgcucccuccguggccccucuguuccccggagaacaaauucuguuuuucagaucuaccguuccuggcugcggcggguaucccaacagcaauaucgauugucuuauuccgcaggagugggugcagcacuuuuaccaagagggagccccugcucgcacggacgucgcccuccugcgguucaucaaccccgauacaggcagagugcuuuuugaaugcaagcugcauaaacacggguucauuaccguggcguauuccggaaaccacgaccucguuaugccucccaauggcuacuuucgcuucgagagcugggucaaccaguuucauacccuggcuccgauggggacaggcucuggacggagacgcauccaguga

SEQ ID NO: 26811 - RNA, 1644 nt, Artificial Sequence
  derived and/or modified sequence opt5 from capsid_protein_VP1__Norovirus__BAN16283
augaagauggccagcuccgacgcugcccccucuaacgauggcgcggcuaaucuggugccugaggccaacaaugaagucauggcccucgagccgguugugggggcuagcaucgccgcucccguggucggacagcaaaacauuaucgacccuuggauuagagaaaauuucgugcaggcgccccagggcgaguuuaccguuuccccucggaacucucccggggaaaugcugcuuaaucuggagcucggaccugagcugaacccguaccuuagccaccugucccgcauguauaauggcuacgccgggggaaugcaagugcaggucgugcucgccggcaacgcuuucacagccggcaaaaucauuuuugcugccguucccccucauuuccccguggaaaauaucucugcggcccagaucacgaugugcccucacgucauuguggaugugagacagcuggagcccguccugcucccgcugccugacauccggaaccgcuuuuuccauuauaaucaggaaaacacccccagaaugcggcuuguugcuaugcuguacacaccucuccgcgccaauagcggggaggauguguuuaccguguccuguagaguccugacacggcccgcucccgacuucgaguuuaccuuccuugugccuccgacaguugaaagcaagaccaaacccuuuacgcugccuauucucacccugggagagcugucuaacucccgcuuccccgccccuaucgauaugcucuauacagaccccaacgaaggcauugugguccaaccgcagaaugggagaugcacccuggauggaacacuucagggcaccacgcagcuggugccuacacaaaucugugccuuucgggggacccucauuggacagacaagcagaucuuccgacagcaccgauucugcuccccgccggcgcgaccacccucugcauguucagcuuaagaaccuggauggcacccaauacgaccccacagacgaggugccugcgguccucggcgccaucgauuucaaagggacgguguucggagucgcuucccagagagacgugagcggcgaucagguuggggccacccgggcccacgaagugcacaucaauacaaccgaccccagauauacaccgaagcugggauccauucugaugcauucugagagcggcgauuuugucaccgggcagccugugcgcuucacgcccaucggaaugggcgacaacgauuggcaccaaugggagcuccccgacuacuccggccaucugacacuuaauaugaaccuggcuccugccguugcgccggcuuuucccggggaacggauucucuucuuuagaagcaucgugccuucugccggaggcuacgggaccggacagauugauugccugaucccccaggaguggguccagcacuucuaucaagaagccgcuccuucccagagcgccguggcucuuauccgcuacgugaaucccgacaccggccggaacauuuuugaggccaagcugcacagagaaggguucaucacaguugccaauucuggcaacaauccuauugucgugcccccgaacggauauuuucgcuucgaggcgugggugaaucaguuuuacacccucacaccuaugggcacggggcagggacggagacgcaaccaauga

SEQ ID NO: 26812 - RNA, 1644 nt, Artificial Sequence
  derived and/or modified sequence opt5 from capsid_protein_VP1__Norovirus__BAN16285
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaagggacgguguucggagucgcuucucagagagacguguccggccagcagguuggggccacccgggcccacgaagugcacaucaacacaaccgaucccagauauacaccgaagcugggaagcauucugaugcauuccgagucugacgauuuugucaccggccaaccugugcgcuucacgcccaucgggaugggagacaaugauuggcaccagugggagcuccccgacuacagcggccaucugacacuuaacaugaaucuggcuccugccguugcgccggcuuuucccggcgaacggauucucuucuuuagauccauggugccuagcgccgggggauacggcucugggcagaucgauugccugauuccccaggaguggguccaacacuucuaucaggaagccgcuccuucccagagcgccguggcucuuauccgcuacgugaaccccgacaccggacggaauaucuuugaggccaagcugcacagagaaggcuucauuaccguugcgaacucugggaauaacccuaucgucgugcccccgaauggcuauuuucgcuucgaggccugggugaaccaguuuuacacacucaccccuaugggaacaggccaagggcggagacgcaaucaguga

SEQ ID NO: 26813 - RNA, 1644 nt, Artificial Sequence
  derived and/or modified sequence opt5 from capsid_protein_VP1__Norovirus__BAN16287
augaagauggccagcaacgacgcugcccccuccaaugauggcgcggcuaaccuggugccugaagccaauaacgaagucauggcccucgagccgguugcuggggccucuaucgcugcccccguggugggacagcaaaauauuaucgacccuuggauuagagaaaacuucguccaggcgccccagggcgaguuuaccgugagcccucgcaauucccccggggaaaugcugcuuaaccuggagcucggaccugagcugaauccguaccuuucucaccugagccggauguauaacggcuacgccgggggaaugcagguucaagugguccucgcuggcaaugccuucacagcuggcaaaaucauuuuugccgcggugcccccucauuuccccguuaagaacaucuccgccgcucagaucacgaugugcccucacgugauugucgaugugagacagcuggaacccgugcugcucccgcugccugacauccggaaucgcuuuuuccauuauaaccaggagaauacccccagaaugcggcuugucgccaugcuguacacaccucuccgcgcuaacucuggggaagauguuuuuaccgugagcuguagagugcugacacggcccgcccccgacuucgaguuuaccuuccuugucccuccgacaguggaguccaaaaccaagcccuuuacgcugccuauucucacccugggagaacugagcaacucucgcuuccccgccccuaucgauaugcucuauacagaccccaaugagggcauuguugugcaaccgcagaacgggagaugcacccuggauggaacacuucagggcaccacgcagcuggucccuacacaaaucugugcuuuucgggggacccucauuggacagacaucccgcagcucugacuccaccgauagcgcgcccagacggcgcgaccacccucugcaugugcagcuuaaaaaucuggauggcacccaauacgaccccacagacgaaguuccugccgugcucggcgcuaucgauuucaaggggacggucuucggaguggccucucagagagacgucuccggccaacaggugggggccacccgggcucacgagguucacaucaacacaaccgaucccagauauacaccgaagcugggaagcauucugauccauuccgaaucugacgauuuugugaccggccagccuguccgcuucacgcccauugggaugggagacaaugauuggcaccagugggagcuccccgacuacagcggccaucugacacuuaacaugaaucuggccccugcgguggcuccggccuuucccggcgagcggauccucuucuuuagauccaugguuccuagcgccgggggauacggcucugggcagauugauugccugaucccccaggaaugggugcaacacuucuaucaggaggcugccccuucccagagcgcugucgcccuuauccgcuacgugaaccccgacaccggacggaauauuuuugaagcgaaacugcacagagagggcuucaucaccguggccaacucugggaauaacccuauuguugucccccauaauggcuauuuucgcuucgaggcuugggugaaccaguuuuacacacucaccccgaugggaacaggccaagggcggagacgcaaucaguga

SEQ ID NO: 26814 - RNA, 1644 nt, Artificial Sequence
  derived and/or modified sequence opt5 from capsid_protein_VP1__Norovirus__BAN16289
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaagggacggugcugggagucgcuucucagagagacguguccggccagcagguuggggccacccgggcccacgaagugcacaucaacacaaccgaucccagauauacaccgaagcugggaagcauucucaugcauuccgagucugacgauuucgucaccggccaaccugugcgcuuuacgcccaucgggaugggagacaaugauuggcaccagugggagcugcccgacuacagcggccaucuuacacugaacaugaaucucgcuccugccguugcgccggcuuuccccggcgaacggauucuguuuuucagauccaucgugccuagcgccgggggauacggcucugggcagauugauugccuuaucccccaggaguggguccaacacuuuuaucaggaagccgcuccuucccagagcgccguggcucugauccgcuacgugaaccccgacaccggacggaauauuuucgaggccaagcuccacagagaaggcuuuaucaccguugcgaacucugggaauaacccuauugucgugcccccgaauggcuauuuccgcuuugaggccugggugaaccaguucuacacacugaccccuaugggaacaggccaagggcggagacgcaaucaguga

SEQ ID NO: 26815 - RNA, 1644 nt, Artificial Sequence
  derived and/or modified sequence opt5 from capsid_protein_VP1__Norovirus__BAN16291
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucauuagccagaccucucgcuccgccgauagcaccgacucugcucccagaguucggaaccacccucugcaugugcagaugaagaaucuugaugggacacccuacgacccuacggacgagguccccgcggugcugggagccaucgauuucaaaggcaccgucuucggcguggcuucccaacgcaacacaaccgggaauagcguuggagccacaagagcccacgaagugcacaucgacaccacgaacccgcgguauacaccuaagcucggcuccguccugaugaacucugagagcuccgauuuugacgaugggcagcccauuagauucacccccaucggaaugggcgcugacgauuggcaucagugggagcugccugaauacagcgggcaccucacccugaauaugaaucuugccccggcgguggcucccgccuuuccuggagagcgcauucuguucuuucggucuguugugcccuccgccggcggcuacgggagcggacagaucgacugccucauuccucaagaauggguccagcauuucuaucaggaggcugcccccucucagagcgcuguggcccugaucagauacgugaacccugauacaggccgcaauaucuuugaagcgaaacuucaccgggagggguucauuaccguugccaacuccggaaauaaccccaucgucgugccgccuaauggcuauuuuagauucgaggcuugggugaaccaauuuuacacacugacgcccauggggaccggccagggacgccggagaguccaguga

SEQ ID NO: 26816 - RNA, 1644 nt, Artificial Sequence
  derived and/or modified sequence opt5 from capsid_protein_VP1__Norovirus__BAN16293
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucauuagccagaccucucgcuccgccgauagcaccgacucugcucccagaguucggaaccacccucugcaugugcagcuuaagaaucuggaugggacacccuacgacccuacggacgagguccccgcggugcucggagccaucgauuucaaaggcaccgucuucggcguggcuucccaacgcaacacaaccgggaauagcguuggagccacaagagcccacgaagugcacaucgacaccacgaacccgcgguauacaccuaagcugggcuccguccugaugaacucugagagcuccgauuuugacgaugggcagcccauuagauucacccccaucggaaugggcgcugacgauuggcaucagugggagcucccugaauacagcgggcaccugacccuuaauaugaaucuggccccggcgguggcucccgccuuuccuggagagcgcauucucuucuuucggucuguugugcccuccgccggcggcuacgggagcggacagaucgacugccugauuccucaagaauggguccagcauuucuaucaggaggcugcccccucucagagcgcuguggcccuuaucagauacgugaacccugauacaggccgcaauaucuuugaagcgaagcugcaccgggagggguucauuaccguugccaacuccggaaauaaccccaucgucgugccgccuaauggcuauuuuagauucgaggcuugggugaaccaauuuuacacacucacgcccauggggaccggccagggacgccggagaguccaguga

SEQ ID NO: 26817 - RNA, 1644 nt, Artificial Sequence
  derived and/or modified sequence opt5 from capsid_protein_VP1__Norovirus__BAN16295
augaagauggccagcaacgacgcugcccccuccaaugauggcgcggcuaaccuggugccugaagccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggaaguccucgccggcaaugcuuucacagccggcaaaaucauuuuugcugccgugcccccucauuuccccguugagaacaucuccgcggcccagaucacgaugugcccucacgugauugucgaugugagacagcuggaacccgugcugcucccgcugccugacauccggaaucgcuuuuuccauuauaaccaggaggauacccccagaaugcggcuugucgcuaugcuguacacaccucuccgcgccaauucuggggaggacguuuuuaccgugagcuguagagugcugacacggcccgcucccgauuucgaauuuaccuuccuugucccuccgacaguggaguccaagaccaaacccuuuacgcugccuauucucacccugggagaacugagcaacucucgcuuccccgccccuaucgacaugcucuauacagaucccaacgagaccauuguugugcaaccgcagaauggcagaugcacacuggacgggacccuucagggaacgacacagcuggucccuacccaaaucuguuccuuucggggcacacucauuagccagaccucucgcuccgccgauagcaccgacucugcucccagagugcggaaccacccucugcauguucagcuuaagaaucuggaugggacacccuacgacccuacggacgaagugcccgcgguccucggagccaucgauuucaaaggcaccguguucggcgucgcuucccaacgcaacacaaccgggagcuccgugggagccacaagagcccacgagguucacaucgacaccacgaauccgcgguauacaccuaagcugggcucugugcugaugcauagcgaguccagcgauuuugacgaugggcagcccaccagauucacccccauuggaaugggcgcugacgauuggcgccagugggaacucccugaguacucugggcaccugacacuuaacaugaaucuggccccggcggucgcucccgccuuuccuggagaacggauccucuucuuuagauccgugguucccagcgccggcggcuacgggucuggacagauugacugccugaucccucaagagugggugcagcauuucuaucaggaagcugcccccagccaguccgcugucgcccuuauucgcuacgugaacccugauaccggccggaauaucuuugaggcgaagcugcacagagagggguucaucacaguggccaacucuggaaauaaccccauuguugucccgccuaauggcuauuuucgcuucgaggcuugggugaaccaauuuuacacgcucacccccauggggacaggccagggacggagacgcgugcaguga

SEQ ID NO: 26818 - RNA, 1653 nt, Artificial Sequence
  derived and/or modified sequence opt5 from capsid_protein_VP1__Norovirus__BAN16297
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccugugcucacccugggagaacugagcaacucucgcuuccccgccgccauugacaugcucuauacagauccuaaugaguccaucgucgugcaaccccagaacggcagaugcacccuggacgggacacuucagggaaccacgcagcugguuccgacacaaauuugugcuuuucggggcacccucaucagccagacagcgcgcgccgcugauucuguggacuccccucagagagcccgggaucacccccugcauguccaagugaagaaucuugacgggacccaguacgacccuaccgaugacauucccgccguccugggagcuaucgauuucaaaggcacaguguucggcguugccagccagcgcgacgugucugggacgcaggaacaaggacacuaugcgaccagagcucacgaggcccauaucgauacaaccgacccuaaguacgcccccaagcucggcacaauucugaucaaauccgauagcaacgacuuuaauaccaaccagccgauucgguucacgccugucgggaugggagauaauaacuggagacagugggaacugcccgacuacuccggccgccucacacugaauaugaaccuugcucccgccgugucuccuagcuuuccgggggagcggauccuguucuuuagauccauuguucccagcgcuggaggcuauggcucuggguacaucgauugccucaucccucaggagugggugcaacacuucuaucaggaagccgcgcccucccagagcgccgucgcucuggugcgcuacgugaauccugacaccggacggaacauuuuugaggccaaacuucauagagaaggcuuccugaccguugcuaauucugggaacaaucccaucgucgugccucccaacggauauuuucgcuucgaggccugggugaaccaguuuuacacacucgcgccgaugggcagcgggcaaggccggagacgcgcccaguga

SEQ ID NO: 26819 - RNA, 1623 nt, Artificial Sequence
  derived and/or modified sequence opt5 from capsid_protein_VP1__Norovirus__BAR42289
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuaccggaauuugugcuuucagaggccggguuaccgcccagaucaaucagcgcgauagauggcauaugcaacugcagaaccucaauggcacaacguacgaccccaccgaugacgugccugcuccccuggggacaccugacuucaagggagucguguuuggcaugguuagccagcggaacguggggaaugaugcccccggaucuacccgcgcgcaacaggccugggucuccacauauagcccgcaguucgugccuaaacuuggcuccgucaaccugagaauuucugacaaugaugacuuucaguuccaacccaccaaguuuacgcccguggggguuaacgaugacgaugacggacacccuuuccggcagugggaacucccgaauuacagcggcgagcugacacuuaacaugaaucuggcucccccuguggcccccaacuuuccuggcgaacagcuccuguucuuuagauccuucguccccugcagcgggggauacaaccagggcaucaucgauugucugauuccucaagaguggauccagcauuuuuaucaggaaucugcccccucccagagcgacguggcucucauucgcuacguuaauccggauaccgggcggacccuguucgaggccaagcugcacagaucuggauauaucacaguggcgcacagcggcgacuacccucuggucgugcccgcuaacgggcauuuucgcuucgacuccugggugaaucaauucuauucucucgccccuaugggcaccggaaacggccggagacgcgcccaguga

SEQ ID NO: 26820 - RNA, 1617 nt, Artificial Sequence
  derived and/or modified sequence opt5 from capsid_protein_VP1__Norovirus__BAR47616
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgccgaaaccgaucaucgcgacaaguggcacaugcagcugcagaaccucaauggcacaacguacgaucccaccgacgacgugccugcuccccuggggacaccugauuucaaaggagucguguuuggcguugccagccaaagaaacguggggaaugacgcgcccggaucuacccgggcccaugaggcugucaucuccacauauagcccgcaguucgugccuaagcugggcuccgucaacuuucgcucuaaugauaacgacuuccagcugcaacccaccaaguuuacgcccguggggauuaaugaugacggagaucacccuuucagacagugggaacucccggacuacagcggccugcuuacacugaacaugaaucucgcucccccuguugcccccaacuuuccuggcgagcagcugcuguucuuucgguccuucgugcccugcagcgggggauacaaccagggcaucgucgauugucucaucccucaagaauggauucagcacuuuuaucaggagucugcccccucccagagcgacguggcccugaucagauacguuaauccggauaccgggcgcacccuuuucgaggcgaaacugcaucggucuggauauauuacaguggcucacagcggcgacuacccucucgucgugcccgccaacggguauuuuagauucgacuccugggugaaucaauucuacucucuggccccuaugggcaccggaaacggccgccggagagcucaguga

SEQ ID NO: 26821 - RNA, 1617 nt, Artificial Sequence; identical to SEQ ID NO: 26820
  derived and/or modified sequence opt5 from capsid_protein_VP1__Norovirus__BAR63715

SEQ ID NO: 26822 - RNA, 1617 nt, Artificial Sequence; identical to SEQ ID NO: 26820
  derived and/or modified sequence opt5 from capsid_protein_VP1__Norovirus__BAR63718

SEQ ID NO: 26823 - RNA, 1617 nt, Artificial Sequence; identical to SEQ ID NO: 26820
  derived and/or modified sequence opt5 from capsid_protein_VP1__Norovirus__BAR63721

SEQ ID NO: 26824 - RNA, 1623 nt, Artificial Sequence
  derived and/or modified sequence opt5 from capsid_protein_VP1__Norovirus__BAS02083
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauacaaccggcucucacaacuacaccaugaaucucgcuucccagaacuggagcaauuaugaucccacagaggaaaucccugcgccccugggcacgccggacuucguugggaaaauucagggagugcuuacccagacaaccagaacagacggcuccacccgggggcauaaggccacggucuacacaggaucugcugauuuugccccuaagcugggccgcgugcaauucgagaccgacaccaaccacgauuuugaagccaaucagaacacaaaauucacccccguuggggugauccaggacggaggcacaacgcacagaaaugagccccaacaguggguccucccuagcuacuccggccggaacaccccgaaugugcaucuggcucccgccguggcgccuacauuucccggggaacagcuucuguucuuucgcagcaccaugccuggauguucuggcuaucccaacauggaucucgacugccugcugccucaggaguggguucaauacuucuaucaggaggcugcccccgcccaguccgaugucgcucuccugagauuugugaauccggacacagggcgggugcuuuucgaauguaagcugcacaaaagcggauacgucaccguggcccauacgggccagcacgaucucguuaucccucccaacggguauuuuagauucgacucuugggugaaccaauucuacacccuggcuccuaugggcaauggaacaggccgccggagagcccuuuga

SEQ ID NO: 26825 - RNA, 1635 nt, Artificial Sequence
  derived and/or modified sequence opt5 from capsid_protein_VP1__Norovirus__CRL46952
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucauggcuuucgccgcuccugcccccgccggcuuuccugaucugggguccugcgacuggcacaucgagaugagcaaaauccccaauuccucuacccagaacaauccgauugucgugaacagcgucaagccuaauucccagcaguucgugccccaucucagcucuaucacacuggaugacauuguuuccagcggaggcgauuacaucggcaccauucaauggacgucucccccuagcgacuccgggggagcuaacacaaauuuuuggaagaucccggauuauggcucuagccuguccgaagcgagccagcucgcccccgcuguguacccucccggguucaacgaggucaucguguauuuuauggccucuauuccuggacccaaucaguccggcagcccuaaccugguucccugucuucugccgcaggaauacaucacccacuucauuucugagcaagccccuauccagggggaggcugcccuccugcacuacguggaccccgauaccaaucgcaaccuuggcgaauuuaaacuguauccuggaggcuaccucacaugcguccccaauuccagcuccaccgggccgcagcagcugccucuggacggaguguucguguuugcgucuuggguuagcagauucuaucaacucaagcccgucggcacagcugggccugcccggggacgccugggcgugagacgguga

SEQ ID NO: 26826 - RNA, 1623 nt, Artificial Sequence
  derived and/or modified sequence opt5 from capsid_protein_VP1__Norovirus__CRL46955
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucaccuuucaggcccaaaaccaggacccuagccaguccgugaccuucgcuacaaaugaugccagcuuuguccccuaucucggaucuauuuccccgcauaacggcggcgacuuccacgccggggauaucauuggaagccugggcuggaucucugcuccuagcgacaauucccagcugaacguguggacgauucccaaguacgggucuagccuccccgauguuacccaccuggccccugcgguguuuccgcccggauucggcgaggucauccuuuauuuuuacuccacauucccugggagcggccaacccucucagcuucaggugccuugccuccugccccaggaauuuaucacccauuucuguaaugagcaagcuccuauugccggagaggccgcucugcugcacuauguugaccccgauacaggccggaaccucggggaauuuaagcuguacccggacggauucaugaccugcgugccuaauuccgucagcucuggcccccagacgcugccuaucaacgggguguucguguuuguuuccugggucagccgcuucuaccagcucaaacccgugggaacagccuccgcugccagacggcugggccuucgcagaauuuga

SEQ ID NO: 26827 - RNA, 1623 nt, Artificial Sequence
  derived and/or modified sequence opt5 from capsid_protein_VP1__Norovirus__CRL46958
augaagauggccagcaacgacgcuaaucccuccgauggcucugccgcgaaccuggugccugaggucaauaacgaaguuauggcucucgagccgguggugggggccgccaucgcugcccccgucgcuggacagcaaaauaucaucgacccuuggauuagaaacaauuucgugcaggcccccggcggggaauuuaccguuagcccucggaacgcgcccggagagauccugugguccgccccucuuggcccggaucugaaucccuaccucucucaccuggcucgcauguauaacggguacgccggaggcuucgaagugcaggucauucuugcuggcaaugccuuuacagcggggaaaaucaucuucgccgcugugccucccaacuuuccuacggagggacugagccccucccagguuaccauguucccgcauauuaucguggacgucagacaacucgagccugugcugauuccccugccugaugugcggaauaacuuuuaucacuacaaucagucuaacgacagcacaaucaagcucauugccaugcuguauacaccccuucgcgcuaacaaugccggcgaugacgucuucaccguuuccugcagagugcugacccggcccagcccugauuuugacuucaucuuucucgugccgcccacagucgaaucucgcaccaaaccuuucacgauucccauccugaccguggaggaaaugacaaacuccagauuuccuaucccccuugagaagcuguacaccgggccgagcucugccuucguugugcagccucagaauggacgguguacaaccgauggcguccuccuggggacgacacaacugucccccgugaacauuugcaccuuccgcggagacguuacaaauauccagggcagccauaccuauaccaugaaccucgcuucucugaauuggaacaauuacgauccuacagaggaaacgcccgcgccucuuggcacccccgacuuuguggggaaaauucagggaguccugacacagaccacaaagggccaaggguccaccagaggacacaaggccacgguguacacaggcagcgcuuccuucaccccgaaacucgggucuguccaguuucggaccgacacacagaacgauuucgugacccaucaaaauacaaaguuuacgccuguuggagugauccaggacggcgauaccacacaccgcaacgagccccagcaguggguccugcccaauuauagcggcgugaacacccacaauguucaucuugccccugccguggcuccgacaauucccggggaacaacuccuguucuuuagauccagcaugccuggauguucuggcuaccccaacauggaccuggauugccuggucccucaggagugggugcagcacuucuaucaggaagccgcgcccgcucucuccgacguggcccugcuucgguuuguuaacccugauaccgggcgcguccuguucgaguguaaacuccauaagagcggauacgugacgguggcccacaccggccaccaugaccuggucauucccccgaauggguauuuuagauucgauucuugggugaaccaauuuuacacacuugcuccuaugggcaauggaaccggccggagacgcguucuguga

SEQ ID NO: 26828 - RNA, 1623 nt, Artificial Sequence
  derived and/or modified sequence opt5 from capsid_protein_VP1__Norovirus__CRL46961
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugucccauaucaccggcagcagaaacuacacaaugaaucucgcuucccagaacuggaauaacuaugauccuaccgaggaaauccccgcgccucugggcacccccgacuucgucgggaaaauucagggaaugcuuacacagacgacccgggccgacggcucuacacgcgggcacaaggcuaccguguacacaggaagcgccgauuuugccccgaagcugggcagaguucaauucgagaccgacacggaucaugacuuugaagcuaaucagaacacaaaauucaccccugugggggucauccaggauggauccaccacacaccggaaugagccccaacagugggugcuccccagcuacucuggccgcaacacccacaauguucaucuggccccugcgguggcuccgacauuucccggcgaacagcuucuguucuuuagauccacgaugccuggguguagcggauaucccaacauggaccucgauugccugcugccucaggaguggguccaauacuucuaucaggaggccgcccccgcucagucugacguggcccuccugcgguuugugaauccugauaccggcagaguucuuuucgaauguaagcugcacaaaagcggguacgucacaguggcucauaccggacagcacgaccucgugauucccccgaacggcuauuuucgcuucgauuccugggucaaccaauucuacacacuggccccuauggggaauggcaccggacggagacgcgcgguguga

SEQ ID NO: 26829 - RNA, 1623 nt, Artificial Sequence
  derived and/or modified sequence opt5 from capsid_protein_VP1__Norovirus__CRL46964
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgauuucgugguccagccccagaacggacgguguaccacagacggcgugcuccuggggaccacgcaacugagcccugucaauauuugcacauuucgcggagaugugacccauacaaccggcucuagaaacuacaccaugaaucucgccucccagaacuggaauaacuaugaccccacagaggaaacgccugcuccccugggcaccccggacuucguugggaaaauccggggaaugcuuacacagaccacacgcgcggauggcagcaccagagggcacaaggccacgguguacacaggauccgcugacuuugccccuaagcugggccggguccaguucgagaccgauaccgacaaugauuuugacgccaaccaaaauacaaaauucacccccguggggguuauucaggauggaacaacgacccaucgcaacgaacccagacagugggugcucccuucuuacagcggccggaauacacacaacguccaccuggcuccggccguggcgcccaccuuuccuggcgagcaacuucuguucuuuagauccacaaugcccggguguagcggauauccuaauauggaccucgauugccugcugccccaggaaugggugcaguucuuuuaccaggaggcugccccugcccaaucugacguugcucuccugcgcuucgucaaccccgauaccggccgggugcuuuuugaguguaagcugcauaaauccggguaugugacggucgcccacaccggaccgcaugaccucgugaucccucccaacggcuacuucagauucgacagcuggguuaaucaguuuuauacacuggcuccuauggggaacggcaccggacgccggagagccguguga

SEQ ID NO: 26830 - RNA, 1644 nt, Artificial Sequence
  derived and/or modified sequence opt5 from capsid_protein_VP1__Norovirus__CRL46967
augaagauggccagcaacgacgcugcccccuccaaugauggcgcggcuaaccuggugccugaggccaccucugaagucauggcccucgagccgguugugggggcuagcaucgccgcucccguggucggacagcaaaauauuaucgacccuuggauuagagaaaacuucgugcaggcgccccagggcgaguuuacaguuuccccucgcaauucucccggggaaaugcugcuuaaccuggagcucggaccugagcugaauccguaccuuagccaccugucccggauguauaacggcuacgccgggggaaugcaagugcaggucgugcucgccggcaaugcuuucacggccggcaaaaucauuuuugcugccguucccccucauuuccccguggaaaacaucucugcggcccagaucaccaugugcccucacgucauuguggaugugagacagcuggagcccguccugcucccgcugccugacauccggaaucgcuuuuuccauuauaaccaggaaaauacacccagaaugcggcuuguugcuaugcuguacaccccucuccgcgccaacagcggggaggauguguuuacaguguccuguagaguccugacccggcccgcucccgacuucgaguuuacauuccuugugccuccgaccguugaaagcaagacgaaacccuuuacccugccuauucucacacugggagagcugucuaauucccgcuuccccgccccuaucgauaugcucuauaccgaccccaacgaagccauugugguccaaccgcagaacggcagaugcacacuggaugggacccuucagggaacgacacagcuggugccuacccaaaucuguagcuuucggggcacacucauuucucagaccucccgcagcgcugacucuaccgauuccgcgcccagaguucggaaucacccucugcaugugcagcuuaagaaccuggacgggacacccuacgauccuacggacgagguccccgccgugcucggagcuaucgacuucaaaggcaccgucuucggcguggccagccaacgcaauacaaccggguccucuaucggagccacaagagcucacgaaguucacauugauaccacgaacccgcgguaugccccuaagcugggcagcgugcugauguacuccgagagcacagacuuugaugacgggcagcccaccagauucacccccaucggaaugggcgcggaugacuggcaucagugggagcucccugaauacucugggcaccugacacuuaauaugaaccuggcuccggccgucgcccccgcuuuuccuggagagcgcauucucuucuuucgguccgugguucccagcgccggcggcuaugggucuggacauaucgauugccugauuccucaggaaugggugcaacacuucuaccaggaggcugcccccagccaguccgcggucgcccuuaucagauaugugaauccugacaccggccgcaacaucuuugaagcuaagcugcaccgggagggguucauuacaguggccaauucuggaaacaaucccaucguugucccgccuaacggcuacuuuagauucgaggcuugggugaaucaguuuuauacgcucacccccauggggacaggccaaggacgccggagagugcaguga

SEQ ID NO: 26831 - RNA, 1647 nt, Artificial Sequence
  derived and/or modified sequence opt5 from capsid_protein_VP1__Norovirus__CRL46970
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuugugcccccuaccguugagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccucgauaccacaacgcgcgcccaugaggcgaaaaucgacaccacaagcgggagauuuacccccaagcugggaucccuggaaauuagcacagagucuuccgauuucgaccagagccagccgacccgguuuacgccugugggcaucgggguugaucacgaagcugacuuccaacaguggacacuccccgauuacgccggacaguuuacccacaauaugaaccuggcccccgcuguggccccuaauuucccgggcgagcagcuucuguuuuucagaucucaucuccccagcuccggcgggcgcucuaacggaauccuggacugccuugucccucaagagugggugcagcacuuuuaccaggaaagcgcucccucccagagccaagucgcccuggugcgguauguuaauccugauaccggcagaguccucuucgaggcgaagcugcauaaacugggguuuaugacaauugccaagaacggagacucucccaucauugucccucccaacggcuacuuccgcuucgaauccugggugaauccguuuuauacccucgcuccuauggggacaggcaacggacggagacgcauccaguga

SEQ ID NO: 26832 - RNA, 1608 nt, Artificial Sequence
  derived and/or modified sequence opt5 from capsid_protein_VP1__Norovirus__CRL46973
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagaggugcuucuggaacucgagcugggcccugagcuuaauccguuccuggcgcaccucucucgcauguacaacggguaugccggaggcguugaagugcagguccugcuggcuggcaaugccuuuaccgcugggaaacucguguucgccgcgauucccccucauuuuccccuggagaaccuuagcccuggacagaucacaauguucccccacguuauuaucgaugugagaacccuggaaccgguccuccugccucuucccgacgugcggaauaacuuuuuccauuacaaucagcaaccugaggcccgcaugaagcugguggcuaugcucuauacaccccugagauccaacggcucuggggaugacgucuuuaccguuagcugccgggugcugacacgccccuccccugauuucgacuuuaacuaccucgugccgcccaccgucgagagcaaaacgaagccuuucacccugcccauccuuacaauuggagaacugucuaauuccagauuuccugugcccaucgauauucucuauaccagcccgaacgagggcguugugguccagccucagaaugggcggucuacacuggacggagaacuucugggcaccacgcagaucgugcccuccaacauuugugcccuccgcggcagaaucaaugcucacguuccuaacgagcccaaucaauggaaccuccaggugacaaaugccaacgggaccccuuucgaucccacagaagacgucccggccccucugggaacccccgauuuccaggcuaauauuuacggcgugaccgggcagcggaacagcgacucuuccugccgcgcgcaugacggaguccuggccacauggagccccaaauuuacgccuaagcugggcuccgugguucuugggaccugggagaaggaggauuucaauaucaaccaaccgacaagauuuacccccaucggacugcacaauacagaacacuucaaacagugggugcucccuaacuauucuggcaugcugacccuuaacaugaaucuggcucccagcgucgccccucucuuucccggcgagcagauucuguucuuucgguccuucaucccucugaacgggggaaagagcgacggcgccauugauugucuccugccccaagaauggauccagcauuuuuaccaggagucugcuccguccccuacggacguggcccuuauucgcuacacaaaucccgauaccgggagaguucuguucgaagcgaaacuccaccggcagggauuuaucaccguggcuagcucuggcagcaagccuaucgucgugcccccgaacggguauuucagauuugacuccugggugaaucaauucuacucucuggccccuaugggcacaggaaacggccgccggagaguucaguga

SEQ ID NO: 26833 - RNA, 1623 nt, Artificial Sequence
  derived and/or modified sequence opt5 from capsid_protein_VP1__Norovirus__CRL46976
augaagauggccagcaacgacgcugcccccuccgauggcucuaccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugaccccaccauuaagcucaucgccaugcuguauacaccccuucgcgcuaacaacgccggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaauuccagauuucccaucccgcuugagaagcuguucaccgggccuagcucugccuucgugguucagccccagaacggacgguguacaaccgauggcgugcuccuggggacgacacaacuguccccugucaauauuugcaccuuucgcggagacgugauccauauccccggcagcagaaacuacacaaugaaucucgcuucucagaacuggaacuccuaugauccuaccgaggaaauucccgcgccgcugggcaccccugacuucgucgggaaaauccagggagugcuuacacagacgacccggacaaauggcagcacccgcgggcacaaggccacaguuuacaccggauccgcugacuuuucucccaagcugggcagagugcaauucgccacggauacagacaaugauuuugagaccaaccagaauaccaaauucacacccgucggggugauucaggacggaagcaccacaccucggaacgaaccgcaacaguggguucuccccuccuacagcggccgcaauauccauaacgugcaccuggccccugcugucgcccccacguuuccuggcgagcagcuucuguucuuuagaucuaccaugcccggguguuccggauauccuaauauggaucucgacugccugcugccccaggaaugggugcaauacuucuaucaggaggcggcuccggcccagagcgauguggcccuccugcgguuuguuaacccugacacaggcagaguccuuuucgaguguaagcugcacaaaucuggguacgugaccguggcucauacaggacagcacgaucucgucauucccccuaacggcuauuuucgcuucgacagcugggugaaucaauucuacacccuggcccccauggggaacggcacgggacggagacgcgcucuuuga

SEQ ID NO: 26834 - RNA, 1623 nt, Artificial Sequence
  derived and/or modified sequence opt5 from capsid_protein_VP1__Norovirus__CRL46979
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugauccauauccccggcucuagaaacuacacaaugaaucucgccucccagaacuggaauagcuaugauccuaccgaggaaauucccgcuccgcugggcaccccugacuucgucgggaaaauccagggagugcuuacacagacgacccggacaaacggcuccacccgcgggcacaaggcgacaguuuacaccggaucugccgacuuuagccccaagcugggcagagugcaauucgcuacggauacagacaaugauuuugagaccaaccagaauaccaaauucacacccgucggggugauucaggacggauccaccacaccucggaacgaaccgcaacaguggguucuccccagcuacucuggccgcaauauccauaacgugcaccuggccccugccgucgcucccacguuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacaggacagcacgaucucgucauucccccuaacggcuauuuucgcuucgacuccugggugaaucaauucuacacccuggcucccauggggaacggcacgggacggagacgcgcccuuuga

SEQ ID NO: 26835 - RNA, 1623 nt, Artificial Sequence
  derived and/or modified sequence opt5 from capsid_VP1__Norovirus__ABC96332
augaagauggcccccaacgacgcuagcccuuccgauggcucuaccgccaaucuggugccggaggucaacaaugaaguuauggcgcucgagcccguggugggggcugccaucgccgcuccugucgccggacagcaaaacgugauugaccccuggaucagaaauaacuucguucaggcuccuggcggggaauuuacagugagcccccggaaugccccuggagagauucugugguccgcgccgcuuggccccgaucugaacccuuaccucucucaccuggcccgcauguauaauggguacgcuggaggcuucgaaguccaggugauccuugccggcaacgcuuuuacggccgggaaaauuaucuucgcggccguucccccuaauuuucccaccgagggacugagcccgucccaggugacaauguucccucauaucauugucgacgugagacaacucgagcccgugcugaucccucugcccgauguccggaacaauuuuuaucacuacaaccagucuaaugacagcaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucaccguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugagcaucugcacauuucgcggagacgucacccauauccccggcaccagaauuuaccggaugaaucucgccucucagaacuggaauaacuaugauccuacagaggaaauccccgcuccgcugggcacgccugacuucguggggaaaauucagggaaugcuuacccagacaaccaagggcgacggguccacacgcggacacaaggcgaccgucagcacgggcuccguggauuuuacacccaaacuggggucuguucaauucgccaccgacaccgauaaugacuuugagacaggacagaacaccagauucacacccgugggcgucauccaggauggcagcuccgcucaucggaaugaaccucaacagugggugcucccggacuacagcgggcgcacgguucacaacgugcaccuggcccccgccgucgcuccuaccuuucccggagagcagcuucuguucuuuagaucuacaaugccuggcuguuccggguaccccaauauggaucucgacugccugcugccucaggaaugggugcaacauuucuaucaggaggccgcgcccagccagucugauguggcucuccugcgguuuguuaacccggacaccggaagaguccuuuucgaguguaagcugcacaaagccggcuacgugacaguggcccauaccgggcagcacgaucucgucauuccucccaauggcuauuuucgcuucgacagcugggugaaccaauucuacacgcuggcuccuaugggaaauggcgccgggcggagacgcgcucuuuga

SEQ ID NO: 26836 - RNA, 1623 nt, Artificial Sequence
  derived and/or modified sequence opt5 from major_capsid_protein_VP1__Norovirus__ADB27027
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcagcagaaacuacaccaugaaucucgcuacacagaacuggaacucuuaugaucccacggaggaaauuccugcgccccugggcaccccggacuucguggggaaaauccagggaguccuuacacagaccacacgggccgacggcuccacccgcgggcacaaggcuacgguguacacaggaagcgccgauuuuuccccuaagcugggccggauucaauucgccaccgacaccgauaaugacuuugaugcuaaucagaacacaaaauucacccccguuggggugauccaggacggaaauacagcccauagaaacgagccccaacaguggguccucccuucuuacagcggccgcaauucccacaacgugcaccuggcgccggcuguugcccccacguuuccuggcgaacagcuucuguucuuuagaagcaccaugcccggguguucuggauauccuaauauggaucucgacugccugcugccccaggagugggugcaauacuucuaucaggaagccgcuccugcccaguccgaugucgcucuccugcgguuugugaaccccgacacaggcagagugcuuuucgaguguaagcugcauaaaaccggguacguuacagucgcccacaccggacagcaugaucucgugauuccgccuaacggcuauuuucgcuucgacagcugggugaaucaauucuacacgcuggcgcccauggggaacggcaccggacggagacgcgcccuuuga

SEQ ID NO: 26837 - RNA, 1626 nt, Artificial Sequence
  derived and/or modified sequence opt5 from major_capsid_protein_VP1__Norovirus__AEE10003
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugauucagccccggcuuugcacccaugcucgcuggccugcgcccguuuacggccugcucguggacccuucucugcccuccaauccgcaauggcagaacgggagaguccggguggauggaacacuucugggcaccacgccuguuagcggcucuuggguguccuguuucgccgcugaagccgccuaugaguuucagagcgggacaggagaggucgcuaccuucacacucaucgaacaagacggcucugccuacgugcccggggaucgcgcggcuccucugggauaccccgacuuuuccggccagcuggagauugaaguccagaccgagaccacaaagacgggggacaaacucaaggugaccacauucgaaaugguucugggaccugagaccaauguggaucaggcccccuaucaaggcagagucuacgccagcgugaacgcugccgcuucccuugaccugguugauggccgggugcgcgccgucccgagaucuguguauagcuuccaggacgugaucccugaguacaaugaugggcuccugguuccccuugcgcccccuauuggaccguuucugcccggcgaaguccuccugcgguucagaacauauaugcgccagaucgacaccacggaugccgcugccgaggcuaucgacugcgcccugccucaggaauuuauuuccugguucgcgagcaacgccuuuacagugcaaucugaggcucuccugcuucgguacagaaauacccugaccgggcagcuccuguucgaauguaagcuguauuccgagggauacaucgcccuuagcuacucuggcagcggggcucucacauuucccaccgauggcuucuuugagguggucuccugggugccucgccuguaucagcuggccucuguuggaagccucgccacaggccggacgcugaaacaguga

SEQ ID NO: 26838 - RNA, 1626 nt, Artificial Sequence; identical to SEQ ID NO: 26837
  derived and/or modified sequence opt5 from major_capsid_protein_VP1__Norovirus__AEE10006

SEQ ID NO: 26839 - RNA, 1626 nt, Artificial Sequence; identical to SEQ ID NO: 26837
  derived and/or modified sequence opt5 from major_capsid_protein_VP1__Norovirus__AEE10009

SEQ ID NO: 26840 - RNA, 1626 nt, Artificial Sequence
  derived and/or modified sequence opt5 from major_capsid_protein_VP1__Norovirus__AEE10015
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugauucagccccggcuuugcacccaugcucgcuggccugcgcccguuuacggccugcucguggacccuucucugcccuccaauccgcaauggcagaacgggagaguccggguggauggaacacuucugggcaccacgccuguuagcggcucuuggguguccuguuucgccgcugaagccgccuaugaguuucagagcgggacaggagaggucgcuaccuucacacucaucgaacaagacggcucugccuacgugcccggggaucgcgcggcuccucugggauaccccgacuuuuccggccagcuggagauugaaguccagaccgagaccacaaagacgggggacaaacucaaggugaccacauucgaaaugguucugggaccugagaccaauguggaucaggcccccuaucaaggcagagucuacgccagcgugaacgcugccgcuucccuugaccugguugauggccgggugcgcgccgucccgagaucuguguauagcuuccaggacgugaucccugaguacaaugaugggcuccugguuccccuugcgcccccuauuggaccguuucugcccggcgaaguccuccugcgguucagaacauauaugcgccagaucgacaccacggaugccgcugccgaggcuaucgacugcgcccugccucaggaauuuguguccugguucgcgagcaacgccuuuacagugcaaucugaggcucuccugcuucgguacagaaauacccugaccgggcagcuccuguucgaauguaagcuguauuccgagggauacauugcccuuagcuacucuggcagcggggcucucacauuucccaccgauggcuucuuugaggucguguccuggguuccucgccuguaucagcuggccucugugggaagccucgccacaggccggacgcugaaacaguga

SEQ ID NO: 26841 - RNA, 1626 nt, Artificial Sequence; identical to SEQ ID NO: 26837
  derived and/or modified sequence opt5 from major_capsid_protein_VP1__Norovirus__AEE10018

SEQ ID NO: 26842 - RNA, 1626 nt, Artificial Sequence; identical to SEQ ID NO: 26840
  derived and/or modified sequence opt5 from major_capsid_protein_VP1__Norovirus__AEE10021

SEQ ID NO: 26843 - RNA, 1626 nt, Artificial Sequence
  derived and/or modified sequence opt5 from major_capsid_protein_VP1__Norovirus__AEE10024
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugauucagccccggcuuugcacccaugcucgcuggccugcgcccguuuacggccugcucguggacccuucucugcccuccaauccgcaauggcagaacgggagaguccacguggauggaacacuucugggcaccacgccuaucagcggcucuuggguuuccuguuucgccgcugaagccgccuaugaguuucagagcgggauuggagagguggcuacauucaaucucaucgaacaagacggcucugccuacacccccggggaucgggcggcuccucugggauaccccgacuuuuccggccagcuggagauugaaguccagacagagaccaccaagacaggggacaaacucaaggugacgaccuucgaaauggcccugggaccuaagacaaacgucgaucagacccccuaucaaggccgcguguucgccagcaucacaguugcugccucccuugaccugguggauggcagaguccgggcugugccgcgcucuguuuacggguuucaggacaccaucccugaguauaaugauggacuccuggugccccuugcgcccccuauuggcccguuccugcccggggagguccuccugagauuucggacguacaugagacagcuggacgccacagaugccgcugccgaagcuaucgacugcgcccucccucaggaguucgugagcugguuugcguccaacgccuucaccgugcaaagcgaagcucugcuucugcgcuaucggaauacccucacaggacagcugcuguuugaguguaaacuuuacucugaaggcuauauugcccucuccuacagcgggucuggcccccugaccuucccuacagauggauuuuucgagguugucagcugggugcccagacuguaccagcucgcuuccgugggcucucuggccacggggcgcacccuuaagcaguga

SEQ ID NO: 26844 - RNA, 1626 nt, Artificial Sequence
  derived and/or modified sequence opt5 from major_capsid_protein_VP1__Norovirus__AEE10027
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggacaggagaggucgcuaccuucacaaugauugaacaagacggcucugccuacgugcccggggaucgggcggcuccucugggauaccccgacuauuccggccagcuggagaucgaaguccagaccgagaccacaaagacgggggacaaacuccgcgugaccacauuugaaaugauucugggaccuaccacaaauguugaucaggcccccuaccaaggcaagguguaugccagccuuuccaccucugcuagccugaaccucgucgacggcagagugcgggccguuccgcgcuccguguacagcuuccaggauguccugccugaguauaaugacgggcuucuggugccccucgcucccccucugggaccguuccugcccggcgaggugcuccugagauuucggacguacaugagacagcuugauacagccgacgcgaccgcccagccuaucgauugcgcucugccccaagaguucauuucuugguuugccuccaacaauuucaccguucagagcgacgcucuccugauccgcuaucggaacacacugaccgggcagcuucucuuugaagccaagcuguacucugaaggauacaucgcggucagcuauuccggcucugggccucugacauuccccacggauggcuuuuucgagguggugagcugggucccuagacucuuucagcuggccuccgugggaagccuugcuaccggccgcacacugaaacaauga

SEQ ID NO: 26845 - RNA, 1608 nt, Artificial Sequence
  derived and/or modified sequence opt5 from major_capsid_protein_VP1__Norovirus__AGI96385
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagaggugcuucugaaucucgaacugggcccugagcuuaacccguuccuggcgcaccucucucgcauguacaauggguaugccggaggcgcugagguucaggugcugcuggccggcaacgcuuuuaccgccgggaaacucgucuucgcggccauucccccucauuuuccccuggaaaaucuuagcccuggacagaucacaauguucccccacgugauuaucgauguuagaacccuggagccggugcuccugccucuucccgacguccggaacaacuuuuuccauuacaaucagcaaccugaaccccgcaugagacugguggcuaugcucuauacaccccugcgguccaacggcucuggggaugacguguuuaccgucagcugccgcguucugacaagaccuuccccggauuucgacuuuaauuaccucgugcccccuaccguggagagcaagacgaaacccuucacccugccuauccuuacaauuggagagcugucuaacucccgguuucccgucccgaucgaugaacucuauaccagcccuaaugagggcgugauuguucagccccagaacgggcgcucuacacuggacggagaacuucugggcaccacgcagcucgugccuuccaauaucugugcccugagaggccggauuaacgcucaaguccccgaugaccaccaucaguggaaucuucaggugacaaacgccaaugggaccagcuucgauccuacagaggacguucccaccccgcucggaaccccugacuuccuggccaacaucuacggcgugacaucucagcgcaaucccgauaacacgugcagagcucacgacgggguccuugcgaccuggucccccaaguuuacaccuaaacugggaagcgugguccucggcaccugggaagaguccgaucuggaccuuaaucaaccgacacgguucacccccguggggcuguaugauacgaaccacuuugaccaguggauucucccuaauuacucuggacgccugacacugaacaugaaccucgcccccagcguugcuccucuguuccccggcgagcagauccuguuuuucagaucccauaucccucugaagggcgggaccagcaauggagccauugauugucuccugccccaagaauggauccagcacuuuuaccaggagucugccccguccccuaccgacguggcucugauucgguauacaaaccccgauaccggcagaguccuuuucgaagccaagcuccaucgccagggguuuaucacaguggcgaauagcggaucucggccuauuguugugcccccgaacggcuacuucagauuugacagcugggucaaucaauucuauucccuggcuccuauggggacgggcaacggacgccggagagugcaguga

SEQ ID NO: 26846 - RNA, 1644 nt, Artificial Sequence
  derived and/or modified sequence opt5 from major_capsid_protein_VP1__Norovirus__AGI96397
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucaaugcggcccagaucacgaugugcccucacgucauuguggaugugagacagcuggagcccguccugcucccgcugccugacauccggaaccgcuuuuuccauuauaaucaggaaaacaccuccagaaugcggcuuguugcuaugcuguacacaccccuccgcgccaacucuggggaggauguguuuaccgugagcuguagaguccugacacggccugcucccgacuucgaguuuaccuuccuugugcccccuacaguugaauccaagaccaaaccguuuagccugcccauucucacgcugggagagcugucuaauucccgcuucccugcccccaucgauaugcucuauaccgacccuaacgaaggcauugugguccaaccccagaaugggagaugcacacuggauggaacccuucagggcacaacccagcuggugccgacgcaaaucugugccuuucgggggacacucauuggacagaccagccgcucuccugacuccacagauagcgcucccagacggcgcgaccacccucugcauguucagcuuaagaaccuggauggcacccaauacgaccccaccgacgaggugccugcgguccucggcgccaucgauuucaaagggacaguguucggagucgcuucucagagagacguguccggccagcagguuggggccacgcgggcccacgaagugcacaucaauaccacagaucccagauauaccccgaagcugggaagcauucugauguacuccgagucugacgauuuugucacaggccaaccugugcgcuucacccccaucgggaugggagacaacgauuggcaucagugggagcuccccgacuacccuggccaccugacgcuuaauaugaaccuggcuccggccguugcgcccgcuuuuccuggcgaacggauucucuucuuuagaagcaucgugcccuccgccgggggauauggcagcgggcagauugauugccugaucccucaggaguggguccaacauuucuaccaggaagccgcucccucucaguccgccguggcucuuauccgcuaugugaauccugacacaggacggaacauuuuugaggccaagcugcacagagaaggcuucaucaccguugcgaauagcgggaacaaucccauugucgugccgccuaacggcuacuuucgcuucgaggccugggugaaucaguuuuauacccucacacccaugggaaccggccaagggcggagacgcgaucaguga

SEQ ID NO: 26847 - RNA, 1608 nt, Artificial Sequence
  derived and/or modified sequence opt5 from major_capsid_protein_VP1__Norovirus__AGI96398
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagaggugcuucugaaucucgaacugggcccugagcuuaacccguuccuggcgcaccucucucgcauguacaauggguaugccggaggcguugaggugcagguccugcuggcuggcaacgccuuuaccgcugggaaacucguguucgccgcgauucccccucauuuuccccuggaaaaucuuagcccuggacagaucacaauguucccccacguuauuaucgaugugagaacccuggagccgguccuccugccucuucccgacgugcggaacaacuuuuuccauuacaaucagcaaccugaaccccgcaugagacugguggccaugcucuauacaccccugcgguccaacggcucuggggaugacgucuuuaccguuagcugccgcgugcugacaagaccuuccccggauuucgacuuuaauuaccucgugcccccuaccgucgagagcaagacgaaacccuucacccugccuauccuuacaauuggagagcugucuaacucccgguuucccgugccgaucgaugaacucuauaccagcccuaaugagggcguuauugugcagccccagaacgggcgcucuacacuggacggagaacuucugggcaccacgcagcucgucccuuccaauaucugugcucugagaggccggauuaacgcccaagugcccgaugaccaccaucaguggaaucugcagguuacaaacgcuaaugggaccagcuucgauccuacagaggacgugcccgccccgcucggaaccccugacuuccuggccaacaucuacggcgucaccucucagcgcaaucccgauaacacaugcagagcucacgacggggugcuugcgacguggucccccaaguuuaccccuaaacugggaagcgucgugcucggcacaugggaagaguccgaucuggaccuuaaucaaccgacccgguucacacccguugggcuguaugauaccaaccacuuugaccaguggauucucccuaauuacucuggacgccugacgcugaacaugaaccucgcccccagcguggcuccucuguuccccggcgagcagauccuguuuuucagaucccauaucccucuuaagggcgggacaagcaauggagccauugauugucuccugccccaagaauggauccagcacuuuuaccaggagucugccccguccccuaccgacgucgcucugauucgguauaccaaccccgauacaggcagagugcuuuucgaagccaagcuccaucgccagggguuuaucaccguugcgaauagcggaucucggccuauuguggugcccccgaacggcuacuucagauuugacagcugggucaaucaauucuauucccuggcuccuauggggacaggcaacggacgccggagagugcaguga

SEQ ID NO: 26848 - RNA, 1608 nt, Artificial Sequence
  derived and/or modified sequence opt5 from major_capsid_protein_VP1__Norovirus__AGI96399
augaagauggccagcaacgacgcugcccccuccaaugaugacgcggcuggccuggugccugaggucaacaaugaaaccauggcccucgagccgguugccggggcuucuaucgccgcuccccugacaggacagaacaaugugauugauccuuggaucagaaugaacuucgugcaagcccccaauggcgaauuuacggucagcccucggaacucccccggggaggugcuucugaaucucgaacugggaccugagcuuaacccguuccuggcgcaccucucucgcauguacaauggcuaugccgggggaguugaggugcagguccugcuggcuggcaacgccuuuaccgcuggcaaacucguguucgccgcgauucccccucauuuuccccuggaaaaucuuagcccugggcagaucacaauguucccccacguuauuaucgacgugagaacccuggagccgguccuccugccucuucccgaugugcggaacaacuuuuuccauuacaaccagcaaccugaaccccgcaugagacugguggccaugcucuauacaccccugcgguccaacggaucuggcgacgaugucuuuaccguuagcugccgcgugcugacaagaccuuccccggacuucgauuuuaauuaccucgugcccccuaccgucgagagcaagacgaaacccuucgcucugccuauccuuaccauuggggagcugucuaacucccgguuucccgugccgaucgacgaacucuauacaagcccuaaugagggaguuauugugcagccccagaacggccgcucuacccuggauggggaacuucugggaacaacccagcucgucccuuccaauaucugugcccugagaggccggauuaacgcucaagugcccgacgaucaccaucaguggaaucugcagguuacgaacgccaauggcaccagcuucgacccuacagaggacgugcccgccccgcucgggacaccugauuuccuggcuaacaucuacggagucaccucucagcgcaaucccgacaauaccugcagagcgcacgauggcgugcuugccacauggucccccaaguuuacgccuaaacuggggagcgucgugcucggaaccugggaagaguccgaccuggaucuuaaucaaccgacacgguucacccccguuggccuguaugacacaaaccacuuugaucaguggauucucccuaauuacucugggcgccugacccugaacaugaaccucgcucccagcguggccccucuguuccccggagagcagauccucuuuuucagaucccauaucccucugaagggcggcacgagcaauggggccauugacugucuccugccccaagaauggauccagcacuuuuaccaggagucugcuccgucccugacagaugucgcccuuauucgguauaccaacccugacaccggaagagugcuuuucgaagcgaagcugcaucgccagggcuuuaucacaguugcuaauagcgggucucggcccauuguggucccucccaacggauacuucagauuugauagcugggugaaucaauucuauucccuggccccgaugggcaccgggaacggccgccggagagugcaguga

SEQ ID NO: 26849 - RNA, 1617 nt, Artificial Sequence
  derived and/or modified sequence opt5 from major_capsid_protein_VP1__Norovirus__AGJ52175
augauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucagcuuucagacccaagaccgggauccuucccagagcgugaccuucgccacaaacgacgcuucuuuuguccccuaucucggauccgugagcccgcauaauggcgagggcuuccaggccggggauauuaucggaucucugggcuggauuagcgccccuuccgacaacucucaguuuaauguuugggcuauccccaaguacgggagcucccugcaaaugagccccauucuccugcuucugugcucuccucgccucugggaagugauccuguauuucuacuccacguuuccgggaagcggccagcccucucagcuucaggucccuugucugcucccccaagaguucaucacccacuuuugcaacgagcaggccccuauugcgggggaagcugcccugcugcacuauguggaucccgacacaggcagaaaucucggagaguucaagcuguacccugauggcuuuaugaccuguguucccaacuccgugagcuccgggccgcagacacuuccuaucaauggagucuucguguucgugucuuggguuagccgguuuuaccagcugaaacccgucggcaccgccuccgcugcccgcagacucgggcugcggagaauuuga

SEQ ID NO: 26850 - RNA, 1641 nt, Artificial Sequence
  derived and/or modified sequence opt5 from major_capsid_protein_VP1__Norovirus__AGX01092
augaugauggccagcaaggacgcuccccaguccgccgauggcgcgucuggggcuggacaacuggugccugaggucaacaccgccgacccgcuccccauggaaccuguugccggccccacaacggcuguggccaccgcuggccaggugaauaugaucgauccuuggauugucaacaauuucgugcagagcccccagggagaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcuuugugcccccuggauucacaucuagcucccugaccaucgcucaggccacacuguuuccccacguuauugcugacgugcgcacccucgaaccgaucgagaugccucuggaagaugucagaaacgugcuuuaucauacgaaugacaaccagcccaccaugcggcugguguguaugcucuacacaccucugcgcaccggcgggggaagcgggucuuccgauagcuucgucguugccgggagagugcuuacagcgcccucuuccgacuuuagcuuccuguuucucgugcccccuaccauugagcaaaagacgcgggccuucacagucccgaauaucccccugcagacccugucuaacucccgcuuuccuagccucauucagggaaugauccugucccccgaugcuucucaggugguucaauuccagaauggcagaugccuuauugacggccagcugcucgggacaaccccugccaccagcggacaacuguuccgggugcgcggcaaaaucaaccagggggcuagaacacuuaaccugacggaggucgauggaaagcccuuuauggccuucgacuccccggccccugugggcuuucccgacuucgggaaaugugauuggcacaugcggaucagcaagaccccuaauaacacaucuuccggagaccccaugcgcagcguuucugugcagaccaauguccagggcuuugugccucaucucggcagcauucaauucgaugaagucuuuaaccaccccacaggggacuauaucggaaccauugaguggaucucccagccgucuacgccucccggcacagauauuaaucugugggaaauccccgacuacgggagcucccugagccaggcugcgaaccucgccccuccgguguuucccccuggauucggcgaggcucugguuuauuucgugucugccuuucccgggccuaauaacagauccgcccccaaugaugucccuugccuucugccccaggaguacaucacccacuucgugagcgaacaagcuccgaccaugggcgacgccgcgcuccugcauuauguugauccugacacaaaccggaaucuuggagaguuuaagcuguaccccggcggguaccucaccugugugccuaacggagucggcgcugggccccagcagcugccgcugaauggaguguuccucuucgugucuuggguuucccgcuuuuaucagcugaaaccugucggcacagccagcacggccagagggcggcuuggcgugagacgcauuuga

SEQ ID NO: 26851 - RNA, 1647 nt, Artificial Sequence
  derived and/or modified sequence opt5 from major_capsid_protein_VP1__Norovirus__AGX01095
augaagauggccagcaacgacgcugcccccuccaaugauggcgcggcugggcuggugccugagaucucuagcgaagccauggcccucgagccggucgcuggagccgcuauugccgcgccccugaccggccagcaaaacaucauugacccuuggaucaugaauaacuucguucaggcccccgggggagaauuuacaguguccccuagaaauucucccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucugagcgcugcccagauuaccaugugcccucaugugaucgucgacgugcgccaacuggaacccguuaaccucccgaugccugaugugagaaauaacuucuuucacuauaaucagggcuccgacucucggcugcgccuuauugccaugcuguacacaccccucagagcuaacaacagcggggaugacgucuucaccguguccugucgggugcugacacgcccuagccccgauuuuucuuucaauuuucuuguucccccuaccgucgaguccaagacaaaaccguucagccugcccauccucaccauuucugaaauguccaacagcagauuuccugugcccaucgacucucugcauacguccccuaccgagaauaucgugguccagugccagaacggacgggugacacuggauggcgagcucauggggaccacacaacugcuucccagccagauuugugcguuccgcggaacccugacgagauccacaucucgggccagcgaccaggcugauaccgccacaccgcgccucuucaauuauuacuggcacauccagcuggacaaccuuaauggcaccccuuaugaccccgccgaagauauuccugcuccccugggcaccccugacuuuagagggaagguuuucggaguggccucccaacggaaccccgaugcgacaacgcgcgcucaugaggccaaaaucgacaccacaagcggcagauuuaccccgaagcucgggucucuggaaauuuccacagagagcggagauuucgaccagaaucagccuacccgguuuacgcccgucggcaucgggguggaucacgaacccgacuuccaacagugggcccugccugauuacgcuggacaguuuacacacaacaugaaucucgccccggcuguugcccccaacuucccuggcgagcagcugcuguuuuucagaucucaacuucccagcuccggcgggcgcucuaauggaauccucgacugccuggugccucaggaguggguccagcauuuuuaccaggaaagcgcgcccucccaaacccagguggcccuuguccgguaugugaacccugauaccggcagaguucuguucgaggcuaagcuccacaaacugcgcuuuaugacaauugccaagagcggggacucucccaucaccgugccgccuaauggauacuuccgguucgaauccugggucaaccccuuuuauacacuggcuccuaugggcacggggaacggcagacgccggauucaguga

SEQ ID NO: 26852 - RNA, 1623 nt, Artificial Sequence
  derived and/or modified sequence opt5 from major_capsid_protein_VP1__Norovirus__AGX01098
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggagugcuuacacagacgacccggacagacggcagcacccgcgggcacaaggcuacagucuacaccggauccgccgauuuugccccuaagcugggcagagugcaauucgagacggacacagaucaugacuuugaaguuaaucagaacaccaaauucacccccgugggggucauccaggauggaggcacaacccaccggaaugagccccaacagugggugcucccuucuuacagcggccgcaacacaccgaaugugcaccuggcucccgccguugcgccuacguuucccggggaacagcuucuguucuuuagauccaccaugccuggauguagcggcuaucccaacauggaccucgauugccugcugccucaggaguggguccaauacuucuaucaggaggcugcccccgcccagucugacguggcucuccugcgguuugugaauccggauacagggagaguccuuuucgaauguaagcugcauaaauccggauacgugaccguugcccacaacggccagcaugaccucgugauuccucccaacggguauuuucgcuucgauagcugggucaaucaauucuacacacuggcuccuaugggcaacggaaccggccggagacgcgcccuuuga

SEQ ID NO: 26853 - RNA, 1623 nt, Artificial Sequence
  derived and/or modified sequence opt5 from major_capsid_protein_VP1__Norovirus__AKI30060
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucuauuaaccugagaaucagcgacaaugaugacuuucaguuccaacccacaaaguuuacccccgucggggugaacgaugacgaugacggacacccuuuccggcagugggaacucccgaauuacuccggcgagcugacgcuuaacaugaaucuggcucccccuguugcccccaacuuuccuggcgaacagcuccuguucuuucgcagcuucgugcccugcucugggggauacaaccagggcaucauugauugucugaucccucaagaguggauucagcauuuuuaucaggaauccgcccccagccagucugacgucgcucucaucagauacgugaauccggauacagggcggacccuguucgaggccaagcugcacagaagcggauauauuaccguugcgcacuccggcgacuacccucuggugguccccgcuaacgggcauuuucgcuucgacucuugggugaaucaauucuauagccucgccccuaugggcacaggaaacggccggagacgcgcccaguga

SEQ ID NO: 26854 - RNA, 1626 nt, Artificial Sequence
  derived and/or modified sequence opt5 from major_capsid_protein_VP1__Norovirus__BAQ94514
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuuagccaccugucccgcauguauaauggcuacgccgggggagucgaggugcagguucuccuggcuggcaacgccuucacagcuggcaaaauccuguuugccgcgaucccucccaauuucccuguggacaugauuucucccgcccagaucaccaugcucccgcaucugauugucgaugugagaacacuugagccuaucaugauuccccugccugacguucggaacguguuuuaucacuucaauaaccagccccaaccccgcaugagacucgucgcuaugcuguacaccccucuucggagcaauggguccggagaugacguguuuacagugagcugccgcguccugaccagaccgacgcccgauuucgaauuuuucuaucucguuccucccucuguggaguccaagaccaagagcuuuacacugccuauccugaccauuucugaaaugacaaacucccgguuccccaucccgaucgagcagcucuacaccgccccuaacgagacgaaugugguccagugucagaacggccgcugcacacuggacggggaacuucaaggaaccacacagcugcucagcucugcuauuuguuccuauagaggccggacccuggccaauaacgauagcugggaccagaaucuucugcagcucuccuaccccaacggggccucuuacgauccuaccgacgaggugcccgcuccucugggaacacaagacuuuagcggcauccuguauggcguucucacgcaggauaaugugaccgaagggacaggagaggcgaagaacgccaaaggcauuuacaucuccaccacaagcgggaaguucacccccaagauuggaucuaucggccugcauuccaucacgggggacguccaccauaaucagcaaagccgcuucacaccggugggaauugcuguuaacgaaaauaccccuuuuaaacagugggugcuuccccacuauucuggcagccuggcccucaacaccaaucuggcccccgcugucgccccuacauucccgggcgagcagcuucuguuuuucagaucccgggugcccugcguccaggggcuccacggacaagaugcguuuaucgacugucugcugccucaggagugggugaaccauuucuaccaggaagcugcccccucucagaccgauguugcccucauucgcuuugugaauccugacacaggcagaacgcuguucgaggcuaaacuucaccggagcggguuuaucaccgucucccauacaggaaacuauccccuggugauuccucccaacggccacuucagauuugauagcuggguuaaucaauucuacucucucgccccgauggggaccggcaacggacgccggagaauccaguga

SEQ ID NO: 26855 - RNA, 1626 nt, Artificial Sequence
  derived and/or modified sequence opt5 from major_capsid_protein_VP1__Norovirus__BAQ94516
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuuagccaccugucccgcauguauaauggcuacgccgggggagucgaggugcagguucuccuggcuggcaacgccuucacagcuggcaagauccuguuugccgcgaucccucccaauuucccuguggacaugauuucucccgcccagaucaccaugcucccgcaucugauugucgaugugagaacacuugagccuaucaugauuccccugccugacguucggaacguguuuuaucacuucaauaaccagccccaaccccgcaugagacucgucgcuaugcuguacaccccucuucggagcaauggguccggagaugacguguuuacagugagcugccgcguccugaccagaccgacgcccgauuucgaauuuuucuaucucguuccucccucuguggaguccaagaccaaaccuuuuacacugcccauccugaccauuagcgaaaugacaaacucucgguucccgaucccuaucgagcagcucuacaccgcccccaacgagacgaaugugguccagugucagaacggccgcugcacacuggacggggaacuucaaggaaccacacagcugcucuccagcgcuauuuguucuuauagaggccggacccuggccaauaacgauuccugggaccagaaucuucugcagcucagcuacccuaacggggccuccuacgaucccaccgacgaggugccugcuccccugggaacacaagacuuuucuggcauccuguauggcguucucacgcaggauaaugugaccgaagggacaggagaggcgaagaacgccaaaggcauuuacaucagcaccacauccgggaaguucaccccgaagauuggaagcaucggccugcauucuaucacgggggacguccaccauaaucagcaaucccgcuucacaccugugggaauugcuguuaacgaaaauacccccuuuaaacagugggugcuuccccacuauagcggcucucuggcccucaacaccaaucuggccccugcugucgccccgacauuccccggcgagcagcuucuguuuuucagaagccgggugccuugcguccaggggcuccacggacaagaugcguuuaucgacugucugcugccccaggagugggugaaccauuucuaccaggaagcugccccuucccagaccgauguugcccucauucgcuuugugaaucccgacacaggcagaacgcuguucgaggcuaaacuucaccggucuggguuuaucaccgucagccauacaggaaacuauccucuggugauucccccgaacggccacuucagauuugauuccuggguuaaucaauucuacagccucgccccuauggggaccggcaacggacgccggagaauccaguga

SEQ ID NO: 26856 - RNA, 1629 nt, Artificial Sequence
  derived and/or modified sequence opt5 from major_capsid_protein_VP1__Norovirus__BAQ94520
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaacgcaccggagaggccaagaacgcuaaaggcauuuacaucagcacaaccuccgggaaguuuacaccgaagauuggaagcaucggccugcauucuaucaccgaaaauguucacccuaaccagcaauccagauucacgcccgugggggucgcccagaaugagaacacacccuuccagcagugggugcuuccucauuaugccggagcucuggcccucaauaccaaccuggcgccggcugucgcccccaccuuuccuggcgagcaacuucuguucuuucggagccgcgugcccugcguucagggccuccaggggcaggacgccuucauugauugucugcugccucaagaaugggugaaucacuuuuaccaggaggcugcccccucucaggcugacgucgcccucaucagauaugugaacccugauacaggacggacccuguucgaagcgaaacuucacagaagcggcuuuauuacaguuucccauacgggggccuacccccugguggucccgccuaacggacacuuccgcuuugacucuugggugaaucaguucuauagccucgcucccaugggcaccgggaacggccggagacgcgugcaauga

SEQ ID NO: 26857 - RNA, 1629 nt, Artificial Sequence
  derived and/or modified sequence opt5 from major_capsid_protein_VP1__Norovirus__BAQ94524
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagcaucaaccccgcaugagacucgucgccaugcuguacacaccccuucggucuaaugggagcggagaugacguguuuaccguguccugccgcguccugaccagaccuacgccggauuucgaauuuaucuaucucguucccccuagcguggagucuaagaccaaacccuucacacugccuauucugaccaucuccgaacucacaaacagccgguuucccaucccgauugagcagcuguacaccgcuccuaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuaccccuccggagcuagcuacgauccuaccgacgaggugcccgcgccucugggcacacaagacuucuccggcauccuguaugggguccucacgcaggauaaugugucugaacgcaccggagaggccaagaacgcuaaaggcauuuacaucagcacaaccuccgggaaguuuacacccaagauuggaagcaucggccugcacucuaucaccgaaaauguucauccgaaccagcaauccagauucacgccugugggggucgcccagaaugagaacacacccuuccagcagugggugcuuccccacuaugccggagcucuggcccucaauaccaaccuggcgccugcugucgccccgaccuuucccggcgagcaacuucuguucuuucggagccgcgugccuugcguucagggccuccaggggcaggacgccuucauugauugucugcugccccaagaaugggugaaucacuuuuaccaggaggcugccccuucucaggcugacgucgcccucaucagauaugugaaccccgauacaggacggacccuguucgaagcgaaacuucauagaagcggcuuuauuacaguuucccacacgggggccuacccucugguggugcccccgaacggacauuuccgcuuugacucuugggucaaucaguucuauagccucgcuccuaugggcaccgggaacggccggagacgcgugcaauga

SEQ ID NO: 26858 - RNA, 1629 nt, Artificial Sequence
  derived and/or modified sequence opt5 from major_capsid_protein_VP1__Norovirus__BAQ94526
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccacauccgaacucaccaacagccgguuuccgaucccuaucgagcagcuguacacggcucccaacgagaauaacgugguccagugucagaauggccgcugcacacuugacggggaacugcaaggaaccacacagcuccugucuuccgccguguguagcuauagaggccggaccguugccaacucuggggauaauugggaccagaaccuucugcagcucaccuacccuuccggagcuagcuacgaucccacagacgaggugccugcgccccugggcacgcaagacuucuccggcauucuguaugggguccucacccaggauaaugugucugaacgcacaggagaggccaagaacgcuaaaggcaucuacauuagcaccacauccgggaaguuuaccccgaagaucggaagcauuggccugcauucuaucacggaaaauguucacccuaaccagcaauccagauucacacccgugggggucgcccagaaugagaacacccccuuccagcagugggugcuuccucauuaugccggagcucuggcccucaauaccaaccuggcgccggcugucgcccccacauuuccuggcgagcaacuucuguucuuucggagccgcgugcccugcguucagggccuccaggggcaggacgccuucaucgauugucugcugccucaagaaugggugaaucacuuuuaccaggaggcugcccccucucaggcugacgucgcccucauuagauaugugaacccugauaccggacggacacuguucgaagcgaaacuucacagaagcggcuuuaucacgguuucccauaccggggccuacccccugguggucccgccuaacggauauuuccgcuuugacucuugggugaaucaguucuacagccucgcucccaugggcacagggaacggccggagacgcgugcaauga

SEQ ID NO: 26859 - RNA, 1587 nt, Artificial Sequence
  derived and/or modified sequence opt5 from VP1_capsid_protein__Norovirus__ACV89840
augaugauggccagcuccgacgcuacacccccuucugagggcgccaccaaccuggugccggaagucaauacgcagguugugccccucgagccuguggcgggggcugccgccgcugcccccuucaccggacaaaacaaugucaucgauccuuggauuuuucagaacuucgugcaggcuccccagggcgaauuuacaguuagcccuagaaauaccccgggggagauccugcuucggauuccccugggaccuaaccucaaucccuuccuggcccaccuuucccgcauguacaacgcgugggugggcgggauggaagccgagaugauccuggcuggaaaugccuuuacagcuggcaagcuccugauugucgcccugccucccggcuucgaggcgacccaacucacaccggcccaggcuaccgccuuuccucaugugaucgcugacguuagaacgcuggaacccaucccuauuccccuucccgauauccggaacgugcuguuccacuauaauggggacccuaccccgacaauucagaucgucgugaugcucuacacaccccugcgcaccaacggaaauggcgaugacguguuuaccgucucugggagacuucugacgcggccugcccccgauuucagcuuuuccuuccucguuccucccacaguggagcagaaaacccgcucuuuuacacugccgaaccuggccgugagcgaccucuccaauagcagauucccugcucccgucaacauucugcgggcggauccuaacaccacccuugcccuggacuaucaaaauggacgcugcacacucgauggcgcucugcaggggacgacccccacaaacucuuccuuccuuggauaccugagaggcaccguggaccggguuaauagcgaucaggugcauguccaccuccgcgaaccuaacggcgaccccuuucagcuggggcugccgggaccucaaggcgugcccgacuauagagccacacucgauaucuacguugacugggagaauaagaaccaugggaaucccugugagggaacccugaacacgggcucucagacagaauauaccccugggcuuggaacccugacauucaauaaaaccuccggcgauacaccggagcagggcgaccccgugauuaugcggcucgucgccuuucgcagcaaccugacggaucaacuuccugcuuacaauggggccuucggacagggcgaaaaccuggcgcccccugugucucccccuguccccggggagguguuucuccaguucggauccagauacacccggcugggcgaaagagagcuggcuguucagugccuccugccgagcgaguggaucacacacuuuuauuccgaagccgccccuauccaaggggaggcuaugcuucugcgcuacgugcagcccgaccucggccggauucuguucgaagccaagcuguauaaagagggauuugucaccguggcuggcgggacaaauccuguuaccuuccccaucgauggaacguuuguggccgucucuugggugagcagaaacuucgugcuuuccccgaugggcagcgggcagggacgccggagagcggcccucgcugaauga

SEQ ID NO: 26860 - RNA, 1587 nt, Artificial Sequence
  derived and/or modified sequence opt5 from VP1_capsid_protein__Norovirus__ACV89843
augaugauggccagcuccgacgcuacacccccuucugagggcgccaccaaccuggugccggaagucaauacgcagguugugccccucgagccuguggcgggggcugccgccgcugcccccuucaccggacaaaacaaugucaucgauccuuggauuuuucagaacuucgugcaggcuccccagggcgaauuuacaguuagcccuagaaauaccccgggggagauccugcuucggauuccccugggaccuaaccucaaucccuuccuggcccaccuuucccgcauguacaacgcgugggugggcgggauggaagccgagaugauccuggcuggaaaugccuuuacagcuggcaagcuccugauugucgcccugccucccggcuucgaggcgacccaacucacaccggcccaggcuaccgccuuuccucaugugaucgcugacguuagaacgcuggaacccaucccuauuccccuucccgauauccggaacgugcuguuccacuauaauggggacccuaccccgacaauucagaucgucgugaugcucuacacaccccugcgcaccaacggaaauggcgaugacguguuuaccgucucugggagacuucugacgcggccugcccccgauuucagcuuuuccuuccucguuccucccacaguggagcagaaaacccgcccguuuacacugccuaaccuggccgugucugaccucagcaauuccagauuccccgcuccugucaacauucugcgggcggaucccaacaccacccuugcccuggacuaucaaaauggacgcugcacacucgauggcgcucugcaggggacgaccccuacaaacagcucuuuccuuggauaccugagaggcaccguggaccggguuaauuccgaucaggugcauguccaccuccgcgaacccaacggcgacccguuucagcuggggcugccuggaccccaaggcgugcccgacuauagagccacacucgauaucuacguugacugggagaauaagaaccaugggaauccuugugagggaacccugaacacgggcagccagacagaauauaccccggggcuuggaacccugacauucaauaaaaccucuggcgauacacccgagcagggcgacccugugauuaugcggcucgucgccuuucgcuccaaccugacggaucaacuucccgcuuacaauggggccuucggacagggcgaaaaccuggcgccucccgugagcccucccgucccgggggagguguuucuccaguucggaucuagauacacccggcugggcgaaagagagcuggcuguucagugccuccugccuuccgaguggaucacacacuuuuauagcgaagccgcccccauccaaggggaggcuaugcuucugcgcuacgugcagccugaccucggccggauucuguucgaagccaagcuguauaaagagggauuugucaccguggcuggcgggacaaaucccguuaccuucccgaucgauggaacguuuguggccgucuccugggugucuagaaacuucgugcuuagcccuaugggcuccgggcagggacgccggagagcggcccucgcugaauga

SEQ ID NO: 26861 - RNA, 1767 nt, Artificial Sequence
  derived and/or modified sequence opt5 from VP1_capsid_protein__Norovirus__AFV48046
augagacugcagugggaggccuggcggagcaccuuccccggcaugcaaccuccgugcgugggguguggacucggccccucccugcuucgcccuagacggaucguccagcccuaccugcucaugcgcaugucugacgcuguucacagagggaacgccgcggauacacagggagcuagcgccggcgaaggguccaaucuggugccuucuacgguggaccaggccauucccauccaaccugucgcuggagccgcuauugccgcgccgaccgccggccaggugaaccagaucgaucccuggauucgggagaauuuuguucagugcccucuuggcgaguucacagugagcccccgcaacaccccuggggaaguccuguuuaaucucgcucugggacccggccugaacccguaucucucccaucuggccgcuauguacacagggugggugggaaauauggaaguucaacuugugcuggccggcaacgcguucaccgccgggaaggucgugguggcucucaucccucccuauuuuaauaugcagacacugaccacgucucagaucaccuguuucccucacauuaugugcgacgucagaacacuugagcccauccugcucccccugcuggauguucggcgcacccucuggcauccuacaaacagcgaggacgauaccaugagacugguguguaugcuuuacacgccgcugcggacaaauucccccggagacgagagcuuuguggucucuggccgccuccuguccagaccuagccuugauuucaacuuucuguaucucacacccccuauugcccagacccccuacgaacugccgaccgugccucggaugguucccucugaaaugacccacucccgcuggccugcucccaucuaucaaguggucgccgacccuagccugguggccaauccccaguggcagaacggcagaguuacaauugaugggcaacuccugggaacgaccccgaucucuuccacaugggugugcagcauugcuggcaccgcggacuaccgguacaucgccgggacagauuccuucgaggaguguaaacuugcucugucucagccuaauggaagccccuuugucgugggcgacgcccccgccccuuauggguacccggacuucaacgcuaccaucuccuuuagcuuccaggucgaaacgagacagaacucugccuauuccgugcgcgaguucagccucacaaccucuagccaaaccauuaaucagucccccuacacaggaaccguuuauauggaucggucugaaacacaggacuaccaguaucaagaugacagaauccgcggcgugccucauagcguccaguccuuuaaggaucagcugcccgacuacguggagagcggccagccucccaaccuugcgccucccauugggccguucaugccuggagaaguucuggugcgguuuagaacguacguccgccaagaggcuaccgccgcccucuaucaggaucagcccaucgacugcgcucugccucaggaguucgugacacaccuggccacccacggcuacacacucgggucugaugcucugcuucugcgguauagaaaucuccgcaccggacaacugauuugugaagccaaacuguacgcggagggcuuucuugccaucuccuauagcgggacgggcccccuccagcugccgaccgacggaguguucgaaguugucucuugggugcagcggcuguaccaacucgcuccugugggcacauccaccgccgggagaagccugggauccuga

SEQ ID NO: 26862 - RNA, 1767 nt, Artificial Sequence
  derived and/or modified sequence opt5 from VP1_capsid_protein__Norovirus__AFV48048
augagacugcagugggaggccuggcggagcaccuuccccggcaugcaaccuccgugcgugggguguggacucggccccucccugcuucgcccuagacggaucguccagcccuaccugcucaugcgcaugucugacgcuguucacagagggaacgccgcggauacacagggagcuagcgccggcgaaggguccaaucuggugccuucuacgguggaccaggccauucccauccaaccugucgcuggagccgcuauugccgcgccgaccgccggccaggugaaccagaucgaucccuggauucgggagaauuuuguucagugcccucuuggcgaguucacagugagcccccgcaacaccccuggggaaguccuguuuaaucucgcucugggacccggccugaacccguaucucucccaucuggccgcuauguacacagggugggugggaaauauggaaguucaacuuauccuggccggcaacgcguucaccgccgggaagguggucguggcucucaucccucccuauuuuaauaugcagacacugaccacgucucagauuaccuguuucccucacaucaugugcgacgugagaacacuugagcccauucugcucccccugcuggauguccggcgcacccucuggcauccuacaaacagcgaggacgauaccaugagacugguuuguaugcuuuacacgccgcugcggacaaauucccccggagacgagagcuuuguggugucuggccgccuccuguccagaccuagccuugauuucaacuuucuguaucucacacccccuaucgcccagacccccuacgaacugccgaccgucccucggaugauucccucugaaaugacccacucccgcuggccugcucccaucuaucaagugguugccgacccuagccugcucgccaauccccaguggcagaacggcagagugacaauugaugggcaacugcuuggaacgaccccgaucucuuccacaugggucugcagcaucgcuggcaccgcggacuaccgguacauuuccgggucugauagcuucgaggaguguaaacuggcccucucccagccuaauggaagccccuuugugguuggcgacgcucccgccccuuauggguacccggacuucucugccacaaucuccuuuagcuuccagguggaaaccagacagaacucugcuuauagcguccgcgaguucucccugacgacaucuagccaaaccauuaaccagucccccuacaccggaacaguguauauggaucggagcgaaacccuugacuaccaguaucaggaugacagaauccgcggcgucccucauucugugcacgccuuucgggaucaacugcccgacuacguugaguccggccagccucccaaucucgcgccucccauugggccguucaugccuggagaagugcugcugagauuucgcacauacguccggcaggaggcuacggccgcccucuaucaggaucaacccaucgacugcgcucugccucaggaguucgugacccaccuugccacacauggcuacacccuggggagcgaugcucuccugcugagauaucgcaaccuucggacaggacagcucaucugugaagccaagcuguacgcggagggcuuucuggccauuucuuauuccgggaccggcccccuccagcugccgaucgacggaguuuucgaaguggucagcugggugcaaagacuuuaccagcuggcuccugugggcacguccaccgccgggcgcucucucgcuagcuga

SEQ ID NO: 26863 - RNA, 1623 nt, Artificial Sequence
  derived and/or modified sequence opt5 from VP1_capsid_protein__Norovirus__AGH06682
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacauuccccugaaagaucucuccaauagcagagucccugugcccguucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguuuaucccucuugaaucucccgcgccugucggauuccccgaccugggcgggugugauuggcacgugaauuuuaccuuccaggcccaaaaccaggacccuagccaguccgucaccuuugcuacaaaugaugccagcuucgugcccuaccucggaucuaucuccccgcauaacggcggcgacuuucacgccggggauauuaucggaagccugggcuggauuucugcuccuagcgacaauucccagcugaacguuuggacgauccccaaguaugggucuagccuccccgaugugacccaccuggccccugcggucuucccgcccggauuuggcgaggugauucuuuacuucuauuccacauuuccugggagcggccaaucuucccagcugcagguucccugccuccugccucaggaguucaucacccauuuuuguaaugaacaagcucccaucgccggagaggccgcccuucugcacuacguggacccugauacaggccggaaccucggggaguucaagcuguaucccgacggauucaugaccugcgucccgaauagcgugucuuccggcccucagacgcugcccauuaacgggguguuuguuuucgucagcugggugucccgcuuuuaccagcucaaaccugugggaacagcuucugcugccagacggcugggccuucgcagaaucuga

SEQ ID NO: 26864 - RNA, 1620 nt, Artificial Sequence
  derived and/or modified sequence opt5 from VP1_capsid_protein__Norovirus__AGL98413
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaggcucaugacuccacacucaagcugauugccaugcuuuauacaccccugcgcgcuaauaacgccggcgaugacguuuucaccgugagcugcagagugcucacccggcccucuccugauuuugacuucaucuuucuggucccgcccacaguggaaucccgcaccaaaccuuucacgguucccauucuuaccguggaggaaaugagcaacucuagauuuccuaucccccuggagaagcucuacacagggccguccagcgccuucgucgugcagccucagaauggacgguguaccacagauggcguucugcuggggaccacgcaacucucugcugugaacauuugcaauuuccgcggagacgucacaagagugggcaccucccacgauuauacaaugaaccuggucagccagaauuggaacaauuacgaccccaccgaggaaaucccugcgccccuuggcaccccugacuuuguggggaaaauccagggacugcucacacagacgacccgggccgauggcuccacacgcgcucauaaggccaccguuucuacagggagcgugcacuucacccccaagcugggauccguccaauuuacgacagacaccgauaacgacuuccagaccggccagaauacaaaauuuaccccgguggggguuauucaagauggagaccaccaucagaacgagccucagcagugggugcuucccaauuacagcggcacaucuggccacaacguccaucuggcccccgcuguggccccugcguucccgggggaacaacuccuguuuuucagauccacgaugcccggauguagcggcuauccuaauaugaaccuggauugccuccugccccaggagugggugcuucacuuuuaccaggaagcugccccugcccagucugacguugcucugcuccgguucgucaaucccgauaccgggcgcgugcuguuugaguguaaacuucacaagagcggauauaucacaguggcccauaccggcccuuacgaccuggucauucccccgaacggguauuucagauuugauuccugggugaaccaauucuacacacucgcuccuaugggcaauggaaccggccggagacgcgcccuguga

SEQ ID NO: 26865 - RNA, 1620 nt, Artificial Sequence
  derived and/or modified sequence opt5 from VP1_capsid_protein__Norovirus__AGL98414
augaagauggccagcuccgacgcuaaccccucugauggcagcuccgccaaucuggugccugaggucaacaaugaaguuauggcgcucgagccgguggugggggcugccaucgccgcucccgucgccggacagcaaaacaucaucgacccuuggauuagaaauaacuucgugcaggcucccggcggggaauuuaccguuucuccucggaaugcccccggagagauccuguggagcgcgccucuuuccccggaucugaaccccuaccucucucaccugagccgcauguauaauggcuacgccgggggauucgaagugcaggucauucuugcuggcaacgccuuuacagcuggcaaaaucguguucgccgcgguuccucccaauuuuccuacggaggggcugucccccagccaggugaccauguucccgcauaucauugucgacgugagacaacucgagccugugcugaucccccugccugauguccggaacaauuuuuaucacuacaaccaggccaaugacucuacacucaagcugauugcuaugcuuuauacaccccugcgcgccaacaacgcuggagaugacguuuucaccguguccugcagagugcucacccggcccagcccugauuuugacuucaucuuucuggucccgcccacaguggaaucucgcaccaaaccuuucacgguucccgugcuuaccgucgaggaaaugacaaauuccagauuuccuauuccccuggagcgccucuucaccggcccgagcacagccuucgugguucagccucagaacgggcgguguaccacggauggagugcugcugggcacaacccaacucucugccgucaauaucugcaacuuuagaggggaggugaaucauauugcuggaacacacgacuacaccaugcggcugaccucccagaacuggaauaacuaugaucccacagaagagaucccugcgccccuuggcacgccugacuucgucggccgcauccagggggugcugacccagacaaccagaagcgacggauccacacggucucauaaggccaccguuagcacgggcuccgugcacuuuacacccaaacucgggagcguccaauucaccaccgauacaaccaaugaccugaacgcuggacagaauacaaaguuuacgccggugggcguugaacagaccucuggggaucaccaauccgagccucagcaguggacacuucccaacuacagcggaacccccaaucauaacgugcaccuggccccugccgucgcuccgacauuccccggcgaacagcuccuguuuuuccgcucuacccugccuggcugugggggauaccccaauaugaaccucgacugccugcuuccucaagagugggugcugcauuuuuaucaggaggccgcgcccgcucagagcgauguggcccuccugagauucguuaacccugacacgggccggguccuuuuugaauguaagcugcacagauccggguucauuaccguggcccacucuggaagccaugaucucgugauucccccgaauggcuacuuucgcuucgacuccugggucaaccaguucuauacacuggcuccuauggggaauggcagcggacggagacgcgugguuuga

SEQ ID NO: 26866 - RNA, 1617 nt, Artificial Sequence
  derived and/or modified sequence opt5 from VP1_capsid_protein__Norovirus__AGL98416
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccaugccucuuucuccggaacugaaucccuaccucagccaccugucccgcauguauaacggcuacgccgggggauucgagguccaggugauccuugcuggcaaugccuuuacagcuggcaaaauuaucuucgccgcgaucccucccaacuuuccuacggaugggcugucucccagccagguuaccauguucccgcauauuaucguggacgucagacaacucgagccugugcugauuccccugccugaugugcggaauaacuuuuaucacuacaaucaggccaacgacuccacacucaagcugaucgcuaugcuuuauacaccccugcgcgccaacaaugcuggagaugacgucuucaccguuagcugcagagugcucacccggcccucuccugauuuugacuucauuuuucuggugccgcccacagucgaaucccgcaccaaaccuuucacggugcccauccuuaccguugaugagaugacaaacagcagauuuccuacaccccuggaaaagcuccauaccggcccgaauaacucuauugugguccagccucagaaugggcgguguaccaucgacggagugcugcugggcacgacacaacucuccaccguuaacaucugcaauuuccgcgggagcacaaccagagccggacagucucacgccuacaccaugaaccuggugucccagaauuggaacaauuaugaucccacagaggagauuccugcuccccuuggcacgccugacuucgucggcaaaaucguggggaugcugagccagaccacacgggaaaacuccucuacccgcgcgcauaaggccacagucagcaccggagacgcucacuuuacgcccaaguccggcagcguucucuucacaaccgauaccgacgaucugcaaaaugggcagaacacaagauuuaccccggugggaguggcccaggacggcgagccucaccaaaaugaaccccagcaguggcggcuucccaacuacucugggacaccuggacauaacguccaccuggccccgcccguggcuccuacguuccccggcgagcagcuccuguuuuuccgcuccaccaugccuggcugugggggauaccccaauauggaucuggacugccuccugccucaagaauggguuagacauuuuuaucaggaggccgcgcccgcucagagcgauguggcccuucugcgguucgucaacccggacacaggcagagugcucuuugaguguaaacugcacaaggccggguacauuaccgugucucacacaggaccuuaugaucuuguuauucccccuaauggcuacuuccgcuuugacagcugggucaaccaguucuaugcucuggcccccauggggaccggcacgggacggagacgcgcucucuga

SEQ ID NO: 26867 - RNA, 1629 nt, Artificial Sequence
  derived and/or modified sequence opt5 from VP1,_capsid_protein__Norovirus__BAL60749
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcagcccguucgacccuucugaagauguccccgcgccucucggggugcccgacuuccagggacgcgucuuuggcgugauuucccaaagagauaagcagaaugccgcugggcacaacgagccugccaaucggggacaugacgccguugugcccacauacacggcucaguacaccccgaaacugggccaaguccagaucgggacauggcagaccgaugaccuccaggugaaccaaccuguuaaguucacacccgugggacugaaugauaccgaacacuuuaaccagugggucgugccccgcuaugccggcgcgcugaaucuuaacacgaaucuggcuccuagcguggccccgguuuuccccggcgagagacuccuguuuuuccgguccuacauuccucuuaaagggggauauggcaaccccgccaucgacugccugcucccucaggaguggguccagcauuuuuaccaagaagcugcccccucuaugagcgagguggcucuggugcgcuauaucaauccugauacagggagagcccuguucgaagcgaagcuccaccgggccggauuuaugaccgucuccagcaacaccucugcucccgugguugugccggccaacggcuacuucagauuugacuccugggucaaucaguucuauagccuggcuccuauggggacaggcaacggacgccggagagugcaguga

SEQ ID NO: 26868 - RNA, 1629 nt, Artificial Sequence
  derived and/or modified sequence opt5 from VP1,_capsid_protein__Norovirus__BAL60753
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacaacuccccugggcauaaugagcccgccaaccggggacacgacgcugugguuccgacauacacgagccaguacaccccuaaacugggccagauucaaaucgggacauggcagaccgaugaccugacagugaaucagcccgucaaguucacccccgugggacucaacgauacggaacauuuuaaucaguggguugugccucgcuaugccggcgcccugaaccuuaauacaaaccuggcuccguccgucgcccccguguucccuggcgagagacuccuguuuuuccggucuuacaucccccuuaaagggggauauggcaauccugcgauugacugccugcucccccaagagugggugcagcacuuuuaccaggaagcugccccuagcauguccgagguugcccugguccgcuauaucaaccccgauaccgggagagcucuguucgaagccaagcuccaccgggcuggauuuaugaccgugagcucuaacacauccgccccgguggucgugccugcgaauggcuacuucagauuugacagcuggguuaaccaguucuauucucuggcccccauggggaccggcaauggacgccggagagugcaauga

SEQ ID NO: 26869 - RNA, 1629 nt, Artificial Sequence; identical to SEQ ID NO: 26868
  derived and/or modified sequence opt5 from VP1,_capsid_protein__Norovirus__BAL60755

SEQ ID NO: 26870 - RNA, 1629 nt, Artificial Sequence
  derived and/or modified sequence opt5 from VP1,_capsid_protein__Norovirus__BAL60759
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacgggcaugccggaggcauggagguucaggugaugcuggcgggcaaugccuucacagcugggaaacuggucuuugccgcugugcccccucacuuccccguugaaaaccucucuccucagcagauuaccauguuuccccaugugaucauugaugucagaacacuggagccggugcuucugccucuccccgacgugcggaauaacuucuuucacuacaaucaaaaggaugacccuaaaaugcgcaucgucgccaugcuguauacaccccuuagaagcaacggauccggcgaugacguuuucaccgugucuugccgggugcugacccgccccagcccugauuuugacuucacguaccucgucccgcccaccguggaauccaagacaaaaccuuuuacccugcccauccugacacucggggagcugagcaauucuagauucccuguuuccauugaucagauguauaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuacaacgugaccaucaccaaucugaacggcagcccguucgacccuucugaagauguccccgcgccucucggggugcccgacuuccagggacgcgucuuuggcgugauuucccaaagagauaagcagaaugccgcugggcauaacgagccugccaaucggggacacgacgccguugugcccacauauacggcucaguacaccccgaaacugggccaaguccagaucgggacauggcagaccgaugaccuccaggugaaccaaccuguuaaguucacacccgugggacugaaugauaccgaacauuuuaaccagugggucgugccccgcuacgccggcgcgcugaaucuuaacacgaaucuggcuccuagcguggccccgguuuuccccggcgagagacuccuguuuuuccgguccuauauuccucuuaaagggggauacggcaaccccgccaucgacugccugcucccucaggaguggguccagcacuuuuaucaagaagcugcccccucuaugagcgagguggcucuggugcgcuacaucaauccugauacagggagagcccuguucgaagcgaagcuccaccgggccggauuuaugaccgucuccagcaacaccucugcucccgugguugugccggccaacggcuauuucagauuugacuccugggucaaucaguucuacagccuggcuccuauggggacaggcaacggacgccggagagugcaguga

SEQ ID NO: 26871 - RNA, 1629 nt, Artificial Sequence
  derived and/or modified sequence opt5 from VP1,_capsid_protein__Norovirus__BAL60767
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccauugaaaaucucuccccucagcagaucaccauguuuccccacguuauuaucgaugugagaacacuggagccgguccuucugccucuccccgacgugcggaacaauuucuuucauuauaaccaaaaggaugacccuaaaaugcgcaucguggccaugcuguacacaccccuuagaucuaauggaagcggcgaugacgucuucaccguuuccugccgggugcugacccgccccucuccugauuuugacuucacguaucucgugccgcccaccgucgaaagcaagacaaaaccuuuuacccugcccauucugacacucggggagcuguccaacagcagauucccugugucuaucgaucagauguacaccucccccaacgagguuauuagcgugcagugucagaauggacggugcacgcuugacggcgaacugcaagggacaacccagcuccaggucucuggaaucugugccuuuaagggcgaggugacagcucaucugcacgauaacgaccaccuuuauaauauuaccaucaccaaccugaauggcuccccguucgacccuagcgaagauauucccgcgccucucgggaugcccgacuuccagggacgcguuuuuggcaucaucucucaaagagaucggcacaacuccccugggcauaaugagcccgccaaccgcggacacgacgcuguggucccgacauacacggcccaguacaccccuaagcugggccagauucaaaucgggacauggcagaccgaugaccugacagugagccagcccgucaaauucacccccgugggacucaaugauacggaacauuuuaaccaguggguugugccuagauaugccggcgcucugaaucuuaacacaaaucuggccccguccgucgcgcccguguucccuggcgagcggcuccuguuuuuccgcucuuacauuccccuuaaagggggauauggcaacccugcuaucgacugccugcucccccaagaguggguucagcacuuuuaccaggaagccgccccuagcauguccgagguggcucuggucagauauauuaaucccgauaccgggcgggcccuguucgaagcuaagcuccacagagccggauuuaugaccgugagcucuaacacauccgcgccggugguugucccugccaacggcuacuuccgcuuugacagcugggugaaucaguucuauucucuggcucccauggggaccggcaacggacggagacgcgugcaauga

SEQ ID NO: 26872 - RNA, 1629 nt, Artificial Sequence
  derived and/or modified sequence opt5 from VP1,_capsid_protein__Norovirus__BAL60769
augaagauggccagcaacgacgcugugcccuccaccgauggcgccgcggggcuggucccugagucuaauaacgaaguuauggcucucgagccgguggccggagccgcucuggccgcucccgugacaggccagacgaauaucauugacccuuggaucagagccaacuucguccaagcgcccaauggggaauuuaccgugagcccucggaacucccccggagagguucuucugaaucucgaacugggcccugagcuuaacccguaccuggcccaccucgcucgcauguauaauggguacgccggaggcauggaggugcaggucaugcuggcuggcaacgccuucacagcggggaaacugguguuugccgcuguucccccucauuuccccguggaaaaucucucuccucagcagauuaccauguuuccccacgucaucauugaugugagaacacuggagccggugcuucugccucuccccgacguccggaacaauuucuuucauuauaaccaaaaggaugacccuaaaaugcgcaucguugccaugcuguacacaccccuuagaagcaauggauccggcgaugacguguucaccgugucuugccggguccugacccgccccagcccugauuuugacuucacguaucucgugccgcccaccguugaauccaagacaaaaccuuuuacccugcccauccugacacucggggagcugagcaacucuagauucccuguguccauugaucagauguacaccagccccaacgaggucaucucugugcagugucagaauggacggugcacgcuugacggcgaacugcaagggacaacccagcuccagguuuccggaauuugugcuuuuaagggcgaggugacagcccaucugcacgauaacgaacaccuuuauaaugucaccaucaccaaccugaauggcagcccguucgacccuucugaggacauucccgccccucucggggugcccgauuuccagggacgcgucuuuggcgugaucucccaaagagacaagcacaacacaccugggcauaaugaacccgcuaaccgggcgcacgaugccguugugccgacguacaccgcucaguacacaccuaaacugggacagguccaaauuggcaccuggcagacagacgaucugaccgacaaucagcccgugaaguucacgcccguugggcucaacgauacagagcauuuuaaucaguggguggucccucgcuaugccggagcccugaaccuuaauaccaaccuggcuccgagcguggcccccguguucccuggcgagagacuccuguuuuuccgguccuacaucccccuuaaaggcggguauggaaccccugcgaucgacugccugcucccccaagaauggguucagcacuuuuaccaggaggcugccccuucuaugagcgaagucgcccuggugcgcuauauuaaucccgauacaggcagagcucuguucgaggccaagcuccaccgggcuggguuuaugaccguguccagcaacacaucugccccggucgugguuccugcgaacggauacuucagauuugacuccugggugaaucaguucuauagccuggcccccaugggcacggggaacggccgccggagaauccaauga

SEQ ID NO: 26873 - RNA, 1629 nt, Artificial Sequence
  derived and/or modified sequence opt5 from VP1,_capsid_protein__Norovirus__BAL60771
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaauaucaccauuaccaaccugaauggcuccccguucgacccuagcgaagauauccccgcgccucucggggugcccgacuuccagggacgcgucuuuggcauuaucucucaaagagauaagcacaacuccccugggcauaaugagcccgccaaccggggacacgacgcuguggucccgacauacacggcccaguacaccccuaaacugggccagauccaaauugggacauggcagaccgaugaccugacagugagccagcccguuaaguucacccccgugggacucaaugauacggaacauuuuaaccagugggucgugccucgcuaugccggcgcucugaaucuuaacacaaaucuggccccguccguugcgcccguguucccuggcgagagacuccuguuuuuccggucuuacaucccccuuaaagggggauauggcaacccugcuauugacugccugcucccccaagaguggguccagcacuuuuaccaggaagccgccccuagcauguccgagguggcucuggugcgcuauaucaaucccgauaccgggagagcccuguucgaagcuaagcuccaccgggccggauuuaugaccguuagcucuaacacauccgcgccggucguggugccugccaacggcuacuucagauuugacagcugggucaaucaguucuauucucuggcucccauggggaccggcaacggacgccggagagugcaauga

SEQ ID NO: 26874 - RNA, 1629 nt, Artificial Sequence
  derived and/or modified sequence opt5 from VP1,_capsid_protein__Norovirus__BAL60773
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcaucauuucucaaagagauaagcacaacuccccugggcauaaugagcccgccaaccggggacacgacgcugucgugccgacauacacggcccaguacaccccuaaacugggccagauccaaaucgggacauggcagaccgaugaccugacaguuaaucagcccgugaaguucacccccgucggacucaacgauacggaacauuuuaaucagugggugguuccucgcuaugccggcgcucugaaccuuaauacaaaccuggccccgagcguggcgcccgucuucccuggcgagagacuccuguuuuuccgguccuacauuccccuuaaagggggauauggcaauccugcuaucgacugccugcucccccaagagugggugcagcacuuuuaccaggaagccgccccuucuaugagcgagguggcucugguucgcuauauuaaccccgauaccgggagagcccuguucgaagcuaagcuccaccgggccggauuuaugaccgucuccagcaacacaucugcgccggugguggucccugccaauggcuacuucagauuugacuccugggugaaccaguucuauagccuggcucccauggggaccggcaauggacgccggagaguucaauga

SEQ ID NO: 26875 - RNA, 1629 nt, Artificial Sequence
  derived and/or modified sequence opt5 from VP1,_capsid_protein__Norovirus__BAL60775
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccauugaaaaucucuccccucagcagaucaccauguuuccccacguuauuaucgaugugagaacacuggagccgguccuucugccucuccccgacgugcggaacaauuucuuucauuauaaccaaaaggaugacccuaaaaugcgcaucguggccaugcuguacacaccccuuagaucuaauggaagcggcgaugacgucuucaccguuuccugccgggugcugacccgccccucuccugauuuugacuucacguaucucgugccgcccaccgucgaaagcaagacaaaaccuuuuacccugcccauucugacacucggggagcuguccaacagcagauucccugugucuaucgaucagauguacaccucccccaacgagguuauuagcgugcagugucagaauggacggugcacgcuugacggcgaacugcaagggacaacccagcuccaggucucuggaaucugugccuuuaagggcgaggugacagcucaucugcacgauaacgaccaccuuuauaauauuaccaucaccaaccugaauggcuccccguucgacccuagcgaagauauucccgcgccucucgggguucccgacuuccagggacgcguguuuggcaucaucucucaaagagauaagcacaacuccccugggcauaaugagcccgccaaccggggacacgacgcugucgugccgacauacacggcccaguacaccccuaaacugggccagauucaaaucgggacauggcagaccgaugaccugacagucagccagcccgugaaguucacccccguuggacucaaugauacggaacauuuuaaccaguggguggucccucgcuaugccggcgcucugaaucuuaacacaaaucuggccccguccguggcgcccguuuucccuggcgagagacuccuguuuuuccggucuuacauuccccuuaaagggggauauggcaacccugcuaucgacugccugcucccccaagagugggugcagcacuuuuaccaggaagccgccccuagcauguccgaggucgcucuggugcgcuauauuaaucccgauaccgggagagcccuguucgaagcuaagcuccaccgggccggauuuaugaccgugagcucuaacacauccgcgccgguugucgugccugccaacggcuacuucagauuugacagcugggugaaucaguucuauucucuggcucccauggggaccggcaacggacgccggagaguccaauga

SEQ ID NO: 26876 - RNA, 1629 nt, Artificial Sequence; identical to SEQ ID NO: 26875
  derived and/or modified sequence opt5 from VP1,_capsid_protein__Norovirus__BAL60777

SEQ ID NO: 26877 - RNA, 1629 nt, Artificial Sequence; identical to SEQ ID NO: 26875
  derived and/or modified sequence opt5 from VP1,_capsid_protein__Norovirus__BAL60779

SEQ ID NO: 26878 - RNA, 1629 nt, Artificial Sequence
  derived and/or modified sequence opt5 from VP1,_capsid_protein__Norovirus__BAL60781
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcaucgucucucaaagagauaagcacaacuccccugggcauaaugagcccgccaaccggggacacgacgcugugguuccgacauacacggcccaguacaccccuaaacugggccagauucaaaucgggacauggcagaccgaugaccugacagugaaucagcccgucaaguucacccccgugggacucaacgauaucgaacauuuuaaucaguggguugugccucgcuaugccggcgcucugaaccuuaauacgaaccuggccccgagcgucgcgcccguguucccuggcgagagacuccuguuuuuccgguccuacauuccccuuaaagggggauauggcaauccugcuaucgacugccugcucccccaagagugggugcagcacuuuuaccaggaagccgccccuucuaugagcgagguugcucugguccgcuauauuaaccccgauacagggagagcccuguucgaagcuaagcuccaccgggccggauuuaugaccguguccagcaacaccucugcgccgguggucgugccugccaauggcuacuucagauuugacuccuggguuaaccaguucuauagccuggcucccauggggacaggcaauggacgccggagagugcaauga

SEQ ID NO: 26879 - RNA, 1629 nt, Artificial Sequence
  derived and/or modified sequence opt5 from VP1,_capsid_protein__Norovirus__BAL60783
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaacaccuuuauaaugugaccaucauuaaccugaauggcagcccguucgacccuucugaggacauccccgcuccucucgggguccccgauuuccagggacgcguguuuggcgucauuucccaaagagacaagcacaacaccccugggcauaaugaacccgcgaaccgggcccacgaugcugugguuccgacauacacggcccaguacaccccuaaacugggacagauccaaaucggcacauggcagaccgacgaucugacaaauaaccagcccgugaaguucacccccgucgggcucaaugacacggagcauuuugaucagugggugguuccucgcuaugccggagcucugaaccuuaauacaaaccuggccccgagcguggcgcccgucuucccuggcgagagacuccuguuuuuccgguccuacauuccccuuaaaggcggguauggaaccccugcuaucgacugccugcucccccaagaaugggugcagcacuuuuaccaggaggccgccccuucuaugagcgaaguggcucugguucgcuauauuaaucccgauaccggcagagcccuguucgaggcuaagcuccaccgggccggguuuaugacagucuccagcaacaccucugcgccggugguggucccugccaacggauacuucagauuugacuccugggugaaucaguucuauagccuggcucccaugggcacagggaacggccgccggagaauccaauga

SEQ ID NO: 26880 - RNA, 1629 nt, Artificial Sequence
  derived and/or modified sequence opt5 from VP1,_capsid_protein__Norovirus__BAL60785
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccauugaaaaucucuccccucagcagaucaccauguuuccccacguuauuaucgaugugagaacacuggagccgguccuucugccucuccccgacgugcggaacaauuucuuucauuauaaccaaaaggaugacccuaaaaugcgcaucguggccaugcuguacacaccccuuagaucuaauggaagcggcgaugacgucuucaccguuuccugccgggugcugacccgccccucuccugauuuugacuucacguaucucgugccgcccaccgucgaaagcaagacaaaaccuuuuacccugcccauucugacacucggggagcuguccaacagcagauucccugugucuaucgaucagauguacaccucccccaacgagguuauuagcgugcagugucagaauggacggugcacgcuugacggcgaacugcaagggacaacccagcuccaggucucuggaaucugugccuuuaagggcgaggugacagcucaucugcacgauaacgaccaccuuuauaauguuaccauuaccaaccugaauggcuccccguucgacccuagcgaagauauccccgcgccucucggggugcccgacuuccagggacgcgucuuuggcauuaucucucaaagagauaagcacaacuccccugggcagaaugagcccgccaaccggggacaugacgcuguggucccgacauacacggcccaguacaccccuaaacugggccaaauccagauugggacauggcagaccgaugaccugacagugagccagcccguuaaguucacccccgugggacucaaugauacggaacacuuuaaccaaugggucgugccucgcuaugccggcgcucugaaucuuaacacaaaucuggccccguccguugcgcccguguucccuggcgagagacuccuguuuuuccggucuuacaucccccuuaaagggggauauggcaacccugcuauugacugccugcucccccaggaguggguccagcauuuuuaccaggaagccgccccuagcauguccgagguggcucuggugcgcuauaucaaucccgauaccgggagagcccuguucgaagcuaagcuccaccgggccggauuuaugaccguuagcucuaacacauccgcgccggucguggugccugccaacggcuacuucagauuugacagcugggucaaucaauucuauucucuggcucccauggggaccggcaacggacgccggagagugcaguga

SEQ ID NO: 26881 - RNA, 1629 nt, Artificial Sequence; identical to SEQ ID NO: 26875
  derived and/or modified sequence opt5 from VP1,_capsid_protein__Norovirus__BAL60791

SEQ ID NO: 26882 - RNA, 1629 nt, Artificial Sequence; identical to SEQ ID NO: 26875
  derived and/or modified sequence opt5 from VP1,_capsid_protein__Norovirus__BAL60793

SEQ ID NO: 26883 - RNA, 1629 nt, Artificial Sequence; identical to SEQ ID NO: 26875
  derived and/or modified sequence opt5 from VP1,_capsid_protein__Norovirus__BAL60795

SEQ ID NO: 26884 - RNA, 1629 nt, Artificial Sequence; identical to SEQ ID NO: 26875
  derived and/or modified sequence opt5 from VP1,_capsid_protein__Norovirus__BAL60797

SEQ ID NO: 26885 - RNA, 1629 nt, Artificial Sequence
  derived and/or modified sequence opt5 from VP1,_capsid_protein__Norovirus__BAL60799
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaacuucacgcccgccgggcucagcgauacagaccauuuuaaucagugggugguuccucgcuaugcuggagcccugaaccuuaauaccaaccuggcgccguccguggcucccgucuucccuggcgaaagacuccuguuuuuccggucuuacaucccccuuaagggcggguauggaaccccugccauugauugccugcucccccaagagugggugcagcacuuuuaccaggaggccgcuccuagcauguccgaaguggcccugguucgcuauaucaaucccgacacaggcagagcucuguucgaggccaaacuccaccgggcgggguuuaugaccgucagcucuaacacauccgccccggugguggucccugcuaacggauacuucagauuugauagcugggugaaucaguucuauucucuggcccccaugggcacggggaacggccgccggcggauucaauga

SEQ ID NO: 26886 - RNA, 1629 nt, Artificial Sequence; identical to SEQ ID NO: 26875
  derived and/or modified sequence opt5 from VP1,_capsid_protein__Norovirus__BAL60801

SEQ ID NO: 26887 - RNA, 1629 nt, Artificial Sequence; identical to SEQ ID NO: 26875
  derived and/or modified sequence opt5 from VP1,_capsid_protein__Norovirus__BAL60803

SEQ ID NO: 26888 - RNA, 1629 nt, Artificial Sequence
  derived and/or modified sequence opt5 from VP1,_capsid_protein__Norovirus__BAL60805
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaaugggcaugccggaggcauggagguucaggugaugcuggcgggcaacgccuucacagcugggaaacuggucuuugccgcugugcccccucacuuccccauugaaaaucucuccccucagcagaucaccauguuuccccauguuauuaucgaugugagaacacuggagccgguccuucugccucuccccgacgugcggaacaauuucuuucacuacaaccaaaaggaugacccuaaaaugcgcaucguggccaugcuguauacaccccuuagaucuaauggaagcggcgaugacgucuucaccguuuccugccgggugcugacccgccccucuccugauuuugacuucacguaccucgugccgcccaccgucgaaagcaagacaaaaccuuuuacccugcccauucugacacucggggagcuguccaacagcagauucccugugucuaucgaucagauguauaccucccccaacgagguuauuagcgugcagugucagaauggacggugcacgcuugacggcgaacugcaagggacaacccagcuccaggucucuggaaucugugccuuuaagggcgaggugacagcucaucugcacgauaacgaccaccuuuacaauauuaccaucaccaaccugaauggcuccccguucgacccuagcgaagauauucccgcgccucucgggguucccgacuuccagggacgcguguuuggcaucaucucucaaagagauaagcauaacuccccugggcacaaugagcccgccaaccggggacaugacgcugucgugccgacauauacggcccaguacaccccuaaacugggccagauucaaaucgggacauggcagaccgaugaccugacagucagccagcccgugaaguucacccccguuggacucaaugauacggaacacuuuaaccaguggguggucccucgcuacgccggcgcucugaaucuuaacacaaaucuggccccguccguggcgcccguuuucccuggcgagagacuccuguuuuuccggucuuauauuccccuuaaagggggauacggcaacccugcuaucgacugccugcucccccaagagugggugcagcacuuuuaucaggaagccgccccuagcauguccgaggucgcucuggugcgcuacauuaaucccgauaccgggagagcccuguucgaagcuaagcuccaucgggccggauuuaugaccgugagcucuaacacauccgcgccgguugucgugccugccaacggcuauuucagauuugacagcugggugaaucaguucuacucucuggcucccauggggaccggcaacggacgccggagaguccaauga

SEQ ID NO: 26889 - RNA, 1629 nt, Artificial Sequence
  derived and/or modified sequence opt5 from VP1,_capsid_protein__Norovirus__BAL60809
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaacuucacgcccguggggcucagcgauacagaccauuuuaaucaguggguugugccucgcuaugccggagcucugaaccuuaauaccaaccuggccccguccgucgcgcccguguucccuggcgaaagacuccuguuuuuccggucuuacaucccccuuaagggcggguauggaaccccugcuauugauugccugcucccccaagagugggugcagcacuuuuaccaggaggccgccccuagcauguccgaaguugcucugguccgcuauaucaaucccgacacaggcagagcccuguucgaggcuaaacuccaccgggccggguuuaugaccgugagcucuaacacauccgcgccgguggucgugccugccaacggauacuucagauuugauagcuggguuaaucaguucuauucucuggcucccaugggcacggggaacggccgccggcggauucaauga

SEQ ID NO: 26890 - RNA, 1629 nt, Artificial Sequence
  derived and/or modified sequence opt5 from VP1,_capsid_protein__Norovirus__BAL60811
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaauaucaccauuaccaaccugaauggcuccccguucgacccuagcgaagauauccccgcgccucucggggugcccgacuuccagggacgcgucuuuggcauuaucucucaaagagauaagcacaacuccccugggcauaaugagcccgccaaccggggacacgacgcuguggucccgacauacacggcccaguacaccccuaaacugggccagauccaaauugggacauggcagaccgaugaccugacagugagccagcccguuaaguucacccccgugggacucaaugauacggaacauuuuaaccagugggucgugccucgcuaugccggcgcucugaaucuuaacacaaaucuggccccguccguugcgcccguguucccuggcgagagacuccuguuuuuccggucuuacaucccccuuaaagggggauauggcgacccugcuauugauugccugcucccccaagaguggguccagcacuuuuaccaggaagccgccccuagcauguccgagguggcucuggugcgcuauaucaaccccgacaccgggagagcccuguucgaagcuaagcuccaccgggccggauuuaugaccguuagcucuaauacauccgcgccggucguggugccugccaacggcuacuucagauuugauagcugggucaaccaguucuauucucuggcucccauggggaccggcaauggacgccggagagugcaauga

SEQ ID NO: 26891 - RNA, 1629 nt, Artificial Sequence; identical to SEQ ID NO: 26890
  derived and/or modified sequence opt5 from VP1,_capsid_protein__Norovirus__BAL60813

SEQ ID NO: 26892 - RNA, 1629 nt, Artificial Sequence; identical to SEQ ID NO: 26889
  derived and/or modified sequence opt5 from VP1,_capsid_protein__Norovirus__BAL60815

SEQ ID NO: 26893 - RNA, 1629 nt, Artificial Sequence
  derived and/or modified sequence opt5 from VP1,_capsid_protein__Norovirus__BAL60817
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccauugaaaaucucuccccucagcagaucaccauguuuccccacguuauuaucgaugugagaacacuggagccgguccuucugccucuccccgacgugcggaacaauuucuuucauuauaaccaaaaggaugacccuaaaaugcgcaucguggccaugcuguacacaccccuuagaucuaauggaagcggcgaugacgucuucaccguuuccugccgggugcugacccgccccucuccugauuuugacuucacguaucucgugccgcccaccgucgaaagcaagacaaaaccuuuuacccugcccauucugacacucggggagcuguccaacagcagauucccugugucuaucgaucagauguacaccucccccaacgagguuauuagcgugcagugucagaauggacggugcacgcuugacggcgaacugcaagggacaacccagcuccaggucucuggaaucugugccuuuaagggcgaggugacagcucaucugcacgauaacgaccaccuuuauaauauuaccaucaccaaccugaauggcuccccguucgacccuagcgaagauauucccgcgccucucgggguucccgacuuccagggacgcguguuuggcaucaucucucaaagagauaagcacaacuccccugggcauaaugagcccgccaaccggggacacgacgcugucgugccgacauacacggcccaguacaccccuaaacugggccagauucaaaucgggacauggcagaccgaugaccugacagucagccagcccgugaaguucgcccccguuggacucaaugauaccgaacauuuuaaccaguggguggucccucgcuaugcuggcgcccugaaucuuaacauuaaucuggcgccguccguggcucccguuuucccuggcgagagacuccuguuuuuccggucuuacaucccccuuaaagggggauauggcaacccugccauugacugccugcucccccaagagugggugcagcacuuuuaccaggaagccgcuccuagcauguccgaggucgcccuggugcgcuauaucaaucccgauacggggagagcucuguucgaagccaagcuccaccgggcgggauuuaugacagugagcucuaacaccuccgccccgguugucgugccugcuaacggcuacuucagauuugacagcugggugaaucaguucuauucucuggcccccauggggaccggcaacggacgccggagaguccaauga

SEQ ID NO: 26894 - RNA, 1629 nt, Artificial Sequence; identical to SEQ ID NO: 26875
  derived and/or modified sequence opt5 from VP1,_capsid_protein__Norovirus__BAL60819

SEQ ID NO: 26895 - RNA, 1629 nt, Artificial Sequence; identical to SEQ ID NO: 26875
  derived and/or modified sequence opt5 from VP1,_capsid_protein__Norovirus__BAL60821

SEQ ID NO: 26896 - RNA, 1629 nt, Artificial Sequence
  derived and/or modified sequence opt5 from VP1,_capsid_protein__Norovirus__BAL60823
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggccuggagguucaggugaugcuggcgggcaacgccuucacagcugggaaacucgucuuugccgcugugcccccucauuuccccauugaaaaucuguccccucagcagaucaccauguuuccccacguuauuaucgaugugagaacacuugagccgguccugcucccucugcccgacgugcggaacaauuucuuucauuauaaccaaaaggaugacccuaaaaugcgcaucguggccaugcuuuacacaccccugagaucuaauggaagcggcgaugacgucuucaccguuuccugccgggugcucacccgccccucuccugauuuugacuucacguaucuggugccgcccaccgucgaaagcaagacaaaaccuuuuacccugcccauucucacacugggggagcuuuccaacagcagauucccugugucuaucgaucagauguacaccucccccaacgagguuauuagcgugcagugucagaauggacggugcacgcuggacggcgaacuccaagggacaacccagcugcaggucucuggaaucugugccuuuaagggcgaggugacagcucaccuucaugauaacgaccaccuguauaauauuaccaucaccaaccucaauggcuccccguucgacccuagcgaagauauucccgcgccucuggggguucccgacuuccagggacgcguguuuggcaucaucucucaaagagauaagcacaacuccccugggcauaaugagcccgccaaccggggacacgacgcugucgugccgacauacacggcccaguacaccccuaaacugggccagauucaaaucgggacauggcagaccgaugaccucacagucagccagcccgugaaguucacccccguuggacugaaugauacggaacauuuuaaccaguggguggucccucgcuaugccggcgcucuuaaucugaacacaaaucucgccccguccguggcgcccguuuucccuggcgagagacugcuguuuuuccggucuuacauuccccuuaaagggggauauggcaacccugcuaucgacugccuccugccccaagagugggugcagcacuuuuaccaggaagccgccccuagcauguccgaggucgcucuggugcgcuauauuaaucccgauaccgggagagcccucuucgaagcuaagcugcaccgggccggauuuaugaccgugagcucuaacacauccgcgccgguugucgugccugccaacggcuacuucagauuugacagcugggugaaucaguucuauucucuugcucccauggggaccggcaacggacgccggagaguccaauga

SEQ ID NO: 26897 - RNA, 1629 nt, Artificial Sequence
  derived and/or modified sequence opt5 from VP1,_capsid_protein__Norovirus__BAL60825
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaagagcuuuacccugccuauccugacacucggggagcugucuaacuccagauuccccguuagcauugaucagauguacaccucuccuaacgaggugaucuccguccagugucagaauggacggugcacgcuugacggcgaacugcaagggacaacccagcuccaggugagcggaauuugugccuuuaaaggcgagguuacagcccaucugcacgauaacgaccaccuuuauaaugugaccaucaccaaccugaauggcucucccuucgacccguccgaagauauuccugcuccccucggggucccugacuuccagggacgcguguuuggcgucaucagccaaagagauaagcacaacacacccgggcauaaugagccugcgaaccgggcccacgacgcugugguucccacguacaccgcccaguacacaccgaaacugggacagauucaaaucggcaccuggcagacagaugaccugaccgugaaucagccugucaacuucacgcccguggggcucuccgauacagaccauuuuaaucaguggguugugccccgcuaugccggagcucugaaccuuaauaccaaccuggccccuucugucgcgccgguguuccccggcgaaagacuccuguuuuuccggagcuacaucccucuuaagggcggguauggaacccccgcuauugauugccugcucccucaagagugggugcagcacuuuuaccaggaggccgcccccuccaugagcgaaguugcucugguccgcuauaucaauccugacacaggcagagcccuguucgaggcuaaacuccaccgggccggguuuaugaccgugucuuccaacacaagcgcgcccguggucgugccggccaacggauacuucagauuugauucuuggguuaaucaguucuauagccuggcuccuaugggcacggggaacggccgccggcggauucaauga

SEQ ID NO: 26898 - RNA, 1629 nt, Artificial Sequence; identical to SEQ ID NO: 26875
  derived and/or modified sequence opt5 from VP1,_capsid_protein__Norovirus__BAL60827

SEQ ID NO: 26899 - RNA, 1629 nt, Artificial Sequence; identical to SEQ ID NO: 26875
  derived and/or modified sequence opt5 from VP1,_capsid_protein__Norovirus__BAL60829

SEQ ID NO: 26900 - RNA, 1629 nt, Artificial Sequence; identical to SEQ ID NO: 26875
  derived and/or modified sequence opt5 from VP1,_capsid_protein__Norovirus__BAL60831

SEQ ID NO: 26901 - RNA, 1629 nt, Artificial Sequence
  derived and/or modified sequence opt5 from VP1,_capsid_protein__Norovirus__BAL60833
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaacuucacgcccguggggcucaaugauacagaccauuuuaaccaguggguugugccucgcuaugccggagcucugaaucuuaacaccaaucuggccccgagcgucgcgcccguguucccuggcgaaagacuccuguuuuuccgguccuacaucccccuuaagggcggguauggaaccccugcuauugauugccugcucccccaagagugggugcagcacuuuuaccaggaggccgccccuucuaugagcgaaguugcucugguccgcuauaucaaccccgacacaggcagagcccuguucgaggcuaaacuccaccgggccggguuuaugaccguguccagcaacacaucugcgccgguggucgugccugccaauggauacuucagauuugauuccuggguuaaccaguucuauagccuggcucccaugggcacggggaauggccgccggcggauucaauga

SEQ ID NO: 26902 - RNA, 1629 nt, Artificial Sequence
  derived and/or modified sequence opt5 from VP1,_capsid_protein__Norovirus__BAL60835
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgccaacuucacgcccgucgggcucagcgauacagaccauuuuaaucagugggugguuccucgcuaugcuggagcccugaaccuuaauaccaaccuggcgccguccguggcucccgucuucccuggcgaaagacuccuguuuuuccggucuuacaucccccuuaagggcggguauggaaccccugccauugauugccugcucccccaagagugggugcagcacuuuuaccaggaggccgcuccuagcauguccgaaguggcccugguucgcuauaucaaucccgacacaggcagagcucuguucgaggccaaacuccaccgggcgggguuuaugaccgucagcucuaacacauccgccccggugguggucccugcuaacggauacuucagauuugauagcugggugaaucaguucuauucucuggcccccaugggcacggggaacggccgccggcggauucaauga

SEQ ID NO: 26903 - RNA, 1629 nt, Artificial Sequence; identical to SEQ ID NO: 26889
  derived and/or modified sequence opt5 from VP1,_capsid_protein__Norovirus__BAL60837

SEQ ID NO: 26904 - RNA, 1629 nt, Artificial Sequence; identical to SEQ ID NO: 26889
  derived and/or modified sequence opt5 from VP1,_capsid_protein__Norovirus__BAL60839

SEQ ID NO: 26905 - RNA, 1629 nt, Artificial Sequence
  derived and/or modified sequence opt5 from VP1,_capsid_protein__Norovirus__BAL60841
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguugugccucgcuaugccggagcucugaaccuuaauaccaaccuggccccgagcgucgcgcccguguucccuggcgaaagacuccuguuuuuccgguccuacaucccccuuaaaggcggguauggaaccucugcuauugauugccugcucccucaagagugggugcagcacuuuuaccaggaggccgcccccagcauguccgaaguugcucugguccgcuauaucaauccugacacaggcagagcccuguucgaggcuaagcuccaccgggccggguuuaugaccgugagcucuaacacauccgcgcccguggucgugccggccaacggauacuucagauuugauagcuggguuaaucaguucuauucucuggcuccuaugggcacggggaacggccgccggcggauucaauga

SEQ ID NO: 26906 - RNA, 1629 nt, Artificial Sequence; identical to SEQ ID NO: 26875
  derived and/or modified sequence opt5 from VP1,_capsid_protein__Norovirus__BAL60843

SEQ ID NO: 26907 - RNA, 1629 nt, Artificial Sequence; identical to SEQ ID NO: 26901
  derived and/or modified sequence opt5 from VP1,_capsid_protein__Norovirus__BAL60845

SEQ ID NO: 26908 - RNA, 1629 nt, Artificial Sequence; identical to SEQ ID NO: 26889
  derived and/or modified sequence opt5 from VP1,_capsid_protein__Norovirus__BAL60847

SEQ ID NO: 26909 - RNA, 1629 nt, Artificial Sequence
  derived and/or modified sequence opt5 from VP1,_capsid_protein__Norovirus__BAL60849
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgaauuucgugcaagcccccaacggggaauuuaccgucuccccucggaaugcucccggagaggugcuucugaaccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccauugaaaaccucucuccucagcagaucaccauguuuccccacguuauuaucgaugugagaacacuggagccgguccuucugccucuccccgacgugcggaauaacuucuuucauuauaaucaaaaggaugacccuaaaaugcgcaucguggccaugcuguacacaccccuuagaagcaacggauccggcgaugacgucuucaccguuucuugccgggugcugacccgccccagcccugauuuugacuucacguaucucgugccgcccaccgucgaauccaagacaaaaccuuuuacccugcccauucugacacucggggagcugagcaauucuagauucccuguguccaucgaucagauguacaccagccccaacgagguuauuucugugcagugucagaacggacggugcacgcuugacggcgaacugcaagggacaacccagcuccaggucuccggaaucugugccuuuaagggcgaggugacagcucaucugcacgauaaugaccaccuuuauaacauuaccaucaccaaucugaacggcagcccguucgacccuucugaagauauucccgcgccucucgggguucccgacuuccagggacgcguguuuggcaucaucucccaaagagauaagcacaauagcccugggcauaacgagcccgccaaucggggacacgacgcugucgugccgacauacacggcccaguacaccccuaaacugggccagauucaaaucgggacauggcagaccgaugaccugacagucucccagcccgugaaguucacccccguuggacucaacgauacggaacauuuuaaucaguggguggucccucgcuaugccggcgcucugaaccuuaauacaaaccuggccccgucuguggcgcccguuuucccuggcgagagacuccuguuuuuccggagcuacauuccccuuaaagggggauauggcaauccugcuaucgacugccugcucccccaagagugggugcagcacuuuuaccaggaagccgccccuuccaugagcgaggucgcucuggugcgcuauauuaaccccgauaccgggagagcccuguucgaagcuaagcuccaccgggccggauuuaugaccgugucuuccaauacaagcgcgccgguugucgugccugccaacggcuacuucagauuugacucuugggugaaccaguucuauagccuggcucccauggggaccggcaauggacgccggagaguccaauga

SEQ ID NO: 26910 - RNA, 1629 nt, Artificial Sequence; identical to SEQ ID NO: 26875
  derived and/or modified sequence opt5 from VP1,_capsid_protein__Norovirus__BAL60851

SEQ ID NO: 26911 - RNA, 1647 nt, Artificial Sequence
  derived and/or modified sequence opt5 from VP1__Norovirus__AAT00378
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaccgaaaauaucgugguccagugccagaacggacgggugacacuggacggcgagcucauggggaccacgcaacugcuucccagccagauuugugcuuuccgcggaguucugacaagaucuaccucccgggcgagcgaucaggccgacacagugaccccgcgccucuucaauuauuacuggcacauccagcuggacaaccuuaauggcaccccuuaugaucccgcugaggacauuccuggcccccuggggacaccugauuuuagaggaaaggucuucggcguggccucccaacggaaccccgacucuacgacccgcgcccaugaagcuaaaguugauacaaccgccgggagauuuacaccgaagcucggaagccuggagaucuccaccgaaagcgacgauuucgaccagaaucagccuacgcgguuugcgcccgugggcauuggggucgauagagaggcuggauuccaacaguggucucugcccgacuacuccggccaguuuagccgcaucaugucucucgccccugccguggcuccgaucuuccccggcgaacagcugcuguuuuuccggagccaacuuccuuccucugggggaagaagcaacggcauucucgauugccuggucccccaggagugggugcagcacuuuuaccaggaguccgccccugcucaaacacagguugcccuugugcgcuaugucaaucccgacaccgggcgggugcuguucgaagcgaagcuccacaaacugggauuuaugaccaucgccaagaacggcgacagcccuauuacaguucccccgaauggguacuucagauucgagucuugggugaacccuuuuuauacccuggcucccaugggcacaggaaacggccgccggagaauccaguga

SEQ ID NO: 26912 - RNA, 1626 nt, Artificial Sequence
  derived and/or modified sequence opt5 from VP1__Norovirus__ABD95934
augaagauggccagcaacgacgcugcccccuccaaugauggcgcggcugggcuggugccugagaucaacaccgaaacacucccgcuggagcccgucgccggagccgcucuugccgcugccguuacgggccagucuaauauuaucgacccuuggauuagaaccaacuucgugcaagcgcccaauggggaauuuacagugagcccucggaacucccccggagagguccugcucaaucuggaacuuggcccugaucugaacccguaccucgcccaccugucucgcauguauaauggguacgcuggaggcguggagguucaggugcugcucgccggcaacgcuuucaccgccgggaaaauccuguuugcggccgugcccccuaauuuccccgucgaguuucuuagcccugcucagauuacaaugcugccccaucucaucguugacgugagaacccuggaaccgaucaugauuccucuucccgauguccggaacacauucuuucacuauaauaaccgcccuuccgagagaaugcggcugguggccaugcucuacacgccccugcgcucuaauggaagcggcgacgauguguucaccgucuccugcagaguucugacccggcccacaccugacuuugaguucaccuaucucgugccgcccagcguggaaucuaagacaaaaccuuuuucccugcccauccuuaccauuagcgagcugacgaacucucgcuucccugcucccaucgauucccucuuuacagcccagaacaauaaccugaauguccaaugucagaacgggagaugcacccuugacggagaacugcagggcacaacccagcuccugccgaccgggauuugugccuuccggggaaagaucagcgcugaugugcaaaauucucaucaggaccgcuggcacaugcagcugacaaaccucaauggcacgccuuucgaucccaccgacgacguuccugcgccccugggcacaccugauuuuaccgggcuucuguucggaguggccucccagagaaacgucggcgggacaggaaauaacaccacgcgggcucaugaggugguuauugccacaaccagcacccaauuugugcccaaacucggcuccaucaauuucgggucugaaagcgaggacuuucaggucggaccgccuacaaaguucacccccgugggcaucaagauugaaacaggccacuccuuucgccagugggaucccccuaacuacagcggggcccugacgcuuaauaugaaccuggcuccgcccgucgccccuaauuuccccggagagcaacuccuguuuuucagaucuaacgugccuugcgcgggcgggguuuccgagggaaucauugacugucugcucccccaggaauggauccagcacuuuuaucaggagagcgcuccuucucaaagcgauguggcccugauucgguacgucaaccccgacaccggcagaacacuuuucgaagccaaacugcaucgcaccggguacaucacaguggcucacuccggcgauuauccgcucguugugccuucuaauggauacuuucgguucgacagcuggaucaaccaguucuauucccuggcccccaugggcaccgggaauggaagacgccggguccaguga

SEQ ID NO: 26913 - RNA, 1623 nt, Artificial Sequence
  derived and/or modified sequence opt5 from VP1__Norovirus__ABG49509
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccgacacccacaauuacacaaugaaccucgcuucucagaauuggaacaauuaugaucccacggaagagauuccugcgccccugggcaccccggacuucguggggaaaauccagggaaugcuuacacagaccacaagaggcgacggguccacccggggacauaaggccacggucagcacaggcgaugugcacuuuaccccuaagcuggggucuauucaauucaacaccgacacaaauaacgauuuugaaaccggacagaauacaaaauucacgcccguuggcgugguccaggacggcaacgggacccaccaaaaugagccccagcagugggugcucccuuccuacagcggacgcacaggccauaacguucaccuggcuccggccguggcccccaccuuuccuggggaacagcuucuguucuuuagauccacaaugcccggauguucuggcuacccuaacaugaaucucgauugccugcugccccaagaguggguccagcauuucuaucaggaggcugccccugcgcagagcgacguggcucuccugcgguuugugaaccccgauaccgggcgcguucuuuucgaauguaagcugcacaaauccggcuacgucacgguggcccacaccggacaacaugaccucgugaucccgccuaauggcuauuuuagauucgauagcugggucaaccaguucuacacacuggcccccauggggaauggaaccggccggagacgcgcucuuuga

SEQ ID NO: 26914 - RNA, 1623 nt, Artificial Sequence
  derived and/or modified sequence opt5 from VP1__Norovirus__ABP88833
augaagauggccaccaacgacgcuagccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaagucgaggugauccuugccggcaacgcuuuuaccgccgggaaaauuaucuucgcggccguuccucccaauuuuccuacagagggacugagccccucccaggugaccauguucccgcauaucauugucgacgugagacagcucgaaccugugcugaucccccugccugauguccggaacaauuuuuaucacuacaaccaaucuaaugacagcacaauuaagcucaucgcuaugcuguauaccccucuucgcgccaacaacgcuggcgaugacguuuucacaguguccugcagagugcugacccggcccagcccugauuuugacuucauuuuucucgucccgcccacgguggagucucgcaccaaaccuuucacaguucccauccugaccguggaagagaugacaaauuccagauuuccuauuccccuugagaagcuguucaccgggccgagcucugcccucgucgugcagccucagaacggacgguguacgacagauggcguucugcuggggaccacacagcucucccccgugaauaucugcaccuuccgcggagacgucacccauaucagcggcacaagaacguaccggaugaaccuggccucucaaaauuggaacaauuaugauccuaccgaagagauucccgcuccucuuggcacacccgacuuuguggggaaaauccagggaaugcugacccagacaaccaagggcgacggguccacgcgcggacacaaggcgacagucagcaccggcuccguggauuucaccccgaaacucgggucuguucaguuugccacagacaccgauaacgacuucgaaacaggacaaaauacgagauuuaccccugugggcgucauucaggauggcagcuccgcucaucggaacgagccccagcaaugggugcugcccgacuacagcgggcgcacaguucacaaugugcaccuugccccugccgucgcuccgaccuuccccggagaacagcugcccuuuuucagaucuacaaugcccggcuguuccggguacccuaacauggaucucgacugccugcugccccaggagugggugcagcauuuuuaucaagaggccgcgccuagccagucugauguggcucuccugcgguucguuaaucccgacaccggaagaguccuuuuugaauguaagcugcacaaagccggcuacgugacgguggcccauaccgggcagcacgaucucgucaucccgccuaacggcuauuuccgcuuugacagcugggugaaucaguccuacacacuggcucccaugggaaacggcgccgggcggagacgcgcucuuuga

SEQ ID NO: 26915 - RNA, 1623 nt, Artificial Sequence
  derived and/or modified sequence opt5 from VP1__Norovirus__ABY27560
augaagauggccagcuccgacgcuucucccagcgauggcuccaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucaccguuccuauccugacaguggaggaaaugaccaacagcagauuucccauuccgcuugagaagcuguucacagggccuucuggagccuucgucgugcagccccagaauggccgguguaccacggaugggguucuccugggaacaacccaacuguccccugugaacaucugcacauuucgcggcgacgucacccauaucgccggcacccacgauuacacaaugaaucucgcuagccagaacuggaauaacuaugaccccacggaggaaauuccugcgccccuggggaccccggacuucgugggaaaaauccagggcguccuuacacagaccacaagaggggauggaucuacccggggccauaaggccacgguguccacagggagcguucacuuuaccccuaagcugggauccgugcaauucaccacagacaccaauaacgaucucgagacaggccagaauacgaaauuuacccccgucggcgugguucaggacgggaacucugcucaccaaaaugaaccccagcagugggugcugccuaacuacagcggacgcacaggccauaauguccaccuugccccggccguggcucccaccuucccuggggagcagcugcucuuuuucagauccacaaugcccggauguagcggcuacccuaacaugaaucuggauugccugcucccccaagaaugggugcugcauuuuuaucaggaggccgcgccugcucagucugacguugcccuucugcgguucgucaaccccgauaccgggcgcgugcucuuugaguguaagcugcacaaauccggcuacgugacggucgcccacaccggaccgcaugaccuugugauuccucccaacggcuauuucagauuugauagcuggguuaaucaguucuacacacuggcuccuauggggaacggagccggccggagacgcgcucucuga

SEQ ID NO: 26916 - RNA, 1620 nt, Artificial Sequence
  derived and/or modified sequence opt5 from VP1__Norovirus__ACT76139
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaggcucaugacuccacacucaagcugauugccaugcuuuauacaccccugcgcgcuaauaacgccggcgaugacguuuucaccgugagcugcagagugcucacccggcccucuccugauuuugacuucaucuuucuggucccgcccacaguggaaucccgcaccaaaccuuucacgguucccauucuuaccguggaggaaaugagcaacucuagauuuccuaucccccuggagaagcucuacacagggccguccagcgccuucgucgugcagccucagaauggacgguguaccacagauggcguucugcuggggaccacgcaacucucugcugugaacauuugcaauuuccgcggagacgucacaagagugggcaucucccacgauuauaccaugaaccuggucagccagaauuggaacaauuacgaccccacagaggaaaucccugcgccccuuggcaccccugacuuuguggggaaaauucagggacugcucacccagacaacgcgggccgauggcuccacccgcgcucauaaggccacaguuucuaccgggagcgugcacuucacacccaagcugggauccguccaauuuaccacggacacaaacaaugauuuccagaccggccagaacaccaaauuuacaccgguggggguuauccaagacggagaucaccaucagaaugagccucagcagugggugcuucccaacuacagcggcaccucuggccacaauguccaucuggcccccgcuguggccccuacauucccgggggaacaacuccuguuuuucagauccacgaugcccggauguagcggcuauccuaacaugaaucuggacugccuccugccccaggagugggugcuucacuuuuaccaggaagcggcuccugcccagucugauguugcccugcuccgguucgucaaccccgacaccgggcgcgugcuguuugaguguaaacuucacaagagcggauauauuacaguggcucauaccggcccuuacgaucuggucauucccccgaacggguauuucagauuugacuccugggugaaucaauucuacacacucgccccuaugggcaacggaaccggccggagacgcgcucuguga

SEQ ID NO: 26917 - RNA, 1620 nt, Artificial Sequence
  derived and/or modified sequence opt5 from VP1__Norovirus__ACT76142
augaagauggccagcuccgacgcuaaccccucugauggcagcaccgccaaucuggugccugaggucaacaaugaaguuauggcgcucgagccgguggugggggcugccaucgccgcucccgucgccggacagcaaaacaucaucgacccuuggauuagaaauaacuucgugcaggcucccggcggggaauuuacaguuuccccucggaaugcccccggagagauccuguggucugcgccucuuagcccggaucugaaccccuaccucucccaccugucucgcauguauaauggcuacgccgggggauucgaagugcaggucauucuugcuggcaacgccuuuacggcuggcaaaaucaucuucgccgcgauuccucccaauuuuccuaccgaggggcugagccccucccaggugacaauguucccgcauaucauuguugacgugagacaacucgagccuguccugaucccccugccugaugugcggaacaauuuuuaucacuacaaccaggcccaugacagcacccucaagcugauugcuaugcuuuauacaccccugcgcgccaauaacgcuggagaugacguguucaccgucucuugcagaguucucacacggcccuccccugauuuugacuucaucuuucuggugccgcccaccguggaaagccgcacgaaaccuuucaccguccccauucuuacaguggaggaaaugucuaacuccagauuuccuaucccccuggagaagcucuacaccggcccgagcucugccuucguugugcagccucagaaugggcgguguacaaccgauggaguccugcugggcacgacacaacucuccgccgugaacaucugcaauuuccgcggggacguuaccagagugggaauuagccacgauuauacaaugaaccuggucucccagaauuggaacaauuacgaccccaccgaggaaaucccugcuccccuuggcaccccugacuuugugggcaaaauucaggggcugcucacacagacgacccgggcggauggaucuacacgcgcccauaaggcuaccgucagcacaggcuccgugcacuucacccccaagcuggggagcguucaauuuacgacagacaccaacaaugauuuccagaccggacagaacacaaaauuuaccccggugggcgucauccaagacggggaucaccaucagaaugagccucagcagugggugcuucccaacuacucuggaacauccggccacaauguucaucuggcccccgccguggcuccuacguucccgggcgaacaacuccuguuuuucagaagcaccaugcccggguguucuggauauccuaacaugaaucuggacugccuccugccccaggagugggucagccacuuuuaccaggaagccgcgccugcucaguccgauguggcccuucugcgguucgugaaccccgacacaggccgcguucucuuugaguguaagcugcacaaaucuggguauauuaccgucgcccauacaggaccuuacgaucuugugauucccccgaacggcuauuucagauuugacagcugggugaaucaauucuacacccuggcuccuauggggaacggcuccggacggaagagaguccucuga

SEQ ID NO: 26918 - RNA, 1620 nt, Artificial Sequence
  derived and/or modified sequence opt5 from VP1__Norovirus__ACT76145
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggucucccagaauuggucuaacuacgaccccacagaggaaaucccugcuccccuuggcaccccugacuuuguggggaaaauucagggacugcucacccagacaacgagagcggauggcagcacccgggcccacaaggcuacaguuuccaccgggagcgugcacuucacacccaagcugggaucuguccaauuuaccacggacacaaauaacgauuuccagaccggccagaauaccaaauuuacaccgguggggguuauccaagacggagaucaucaccagaacgagccucagcagugggugcuucccaauuacuccggccgcaccggccauaacguccaccuggcccccgccguggcuccuacauucccgggggaacaacuccuguuuuucagaagcacgaugcccggauguucuggcuauccuaauaugaaccuggacugccuccugccccaggagugggugcuucacuuuuaccaggaagccgcgccugcucagagcgauguugcccugcuccgguucgucaaucccgacaccgggcgcgugcuguuugaguguaaacuucauaaguccggauauauuacaguggcccacaccggcccuuacgaucuggucauucccccgaacggguauuucagauuugacucuugggugaaccaauucuacacacucgcuccuaugggcaauggaaccggccggagacgcgcccuguga

SEQ ID NO: 26919 - RNA, 1620 nt, Artificial Sequence
  derived and/or modified sequence opt5 from VP1__Norovirus__ACT76148
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccugagccgcauguauaacggguacgcuggaggcuucgaaguccaggugauccuugccggcaaugcuuuuacagccgggaaaguuauuuucgcggccgugccucccaacuuuccuacggagggacugucccccucucaggucaccauguucccgcauaucaucguggacgugagacaacucgagccuguccugauuccccugccugauguucggaauaacuuuuaucacuacaaucaggcucaugacagcacacucaagcugaucgccaugcuuuauacaccccugcgcgcuaacaacgccggcgaugacguguucaccguguccugcagaguccucacccggcccagcccugauuuugacuucauuuuucuggugccgcccacaguugaaucucgcaccaaaccuuucacggugcccauccuuaccgucgaggaaauguccaauagcagauuuccuauuccccuggagaagcucuacacagggccgucuuccgccuucgugguucagccucagaacggacgguguaccacagauggcgugcugcuggggaccacgcaacucagcgcugucaauaucugcaacuuccgcggagacgugacacacauugucggcucucaugauuauaccaugaaucuggugucccagaacuggagcaauuacgaccccacagaggaaaucccugcgccccuuggcaccccugacuuuguugggaaaauccagggacugcucacccagacaacgagagccgauggcuccacccgggcucacaaggccacagugucuaccgggagcguccacuucauucccaagcugggauccgugcaauuuacaaccgacacgaacaaugauuuccagacaggccagaacaccaaauuuaccccgguuggggugauccaagacggagaucaucaccagaaugagccucagcaguggguccuucccaacuacagcggccgcacaggccauaaugugcaccuggcccccgcuguggccccuaccuucccgggggaacaacuccuguuuuucagaucuacaguucccggauguuccggcuauccuaacaugaaucuggacugccuccugccccaggagugggucagccacuuuuaccaggaagcggcuccugcccagucugauguggcccuucugcgguucgugaaccccgacacggggcgcguccucuuugaguguaagcugcauaaaagcggauauauuaccguggcucacacaggcccuuacgaucuuguucugcccccgaacggguauuucagauuugacuccugggugaaucaauucuacacccucgccccuaugggcaacggaacaggccggagacgcgcucuguga

SEQ ID NO: 26920 - RNA, 1620 nt, Artificial Sequence
  derived and/or modified sequence opt5 from VP1__Norovirus__ACT76151
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccugucccgcauguauaauggguacgcuggaggcuucgaaguccaggugauccuugccggcaacgcuuuuacagccgggaaaguuauuuucgcggccgugccucccaauuuuccuacggagggacugucucccagccaggucaccauguucccgcauaucaucguggacgugagacaacucgagccuguccugauuccccugccugauguucggaacaauuuuuaucacuacaaccaggcucaugacuccacacucaagcugaucgccaugcuuuauacaccccugcgcgcuaauaacgccggcgaugacguguucaccgugagcugcagaguccucacccggcccucuccugauuuugacuucauuuuucuggugccgcccacaguugaaucccgcaccaaaccuuucacggugcccauccuuaccgucgaggaaaugagcaacucuagauuuccuauuccccuggagaagcucuacacagggccguccagcgccuucgugguucagccucagaauggacgguguaccacagauggcgugcugcuggggaccacgcaacucucugcugucaacaucugcaauuuccgcggagacgugacaagagucggcauuucccacgauuauaccaugaaccuggugagccagaauuggaacaauuacgaccccacagaggaaaucccugcgccccuuggcaccccugacuuuguugggaaaauccagggacugcucacccagacaacgcgggccgauggcuccacccgcgcucauaaggccacagugucuaccgggagcguccacuucacacccaagcugggauccgugcaauuuaccacggacacaaacaaugauuuccagaccggccagaacaccaaauuuacaccgguuggggugauucaagacggagaucaccaucagaaugagccucagcaguggguccuucccaacuacagcggcaccucuggccacaaugugcaucuggcccccgcuguggccccuacauucccgggggaacaacuccuguuuuucagauccacgaugcccggauguagcggcuauccuaacaugaaucuggacugccuccugccccaggaguggguucuucacuuuuaccaggaagcggcuccugcccagucugaugucgcccugcuccgguucgugaaccccgacaccgggcgcgugcuguuugaguguaaacuucacaagagcggauauaucacagucgcucauaccggcccuuacgaucuggugauucccccgaacggguauuucagauuugacuccuggguuaaucaauucuacacacucgccccuaugggcaacggaaccggccggagacgcgcucuguga

SEQ ID NO: 26921 - RNA, 1623 nt, Artificial Sequence
  derived and/or modified sequence opt5 from VP1__Norovirus__ACX31821
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccgucuucacgggaagcgccgauuuugccccgaagcugggccgggugcaauucgcuacagacaccgauaacgacuuugaguccgggcagaauaccaaguucacaccuguuggagugauucaggauggcucuaccacacaucgcaacgaaccccaacaguggguccuccccaauuacagcggcagaacggggcacaacgugcaccuggccccugcgguugcuccgaccuaucccggagagcagcuucuguuuuuccgguccacaaugccuggcuguagcggguaccccaauauggaccucgauugccugcugccucaggaaugggugcaacauuuuuaucaggaggccgcccccgcucagucugacgucgcccuccugagauucgugaacccugauaccggacgcgugcuuuuugaguguaaacugcacaaguccggcuacguuacagucgcucauaccgggcagcacgaccucgugauucccccgaacggcuauuuccgguuugauagcugggugaaucaauucuacacgcuggccccuaugggaaacggcaccgggagacgccgggcgcuuuga

SEQ ID NO: 26922 - RNA, 1623 nt, Artificial Sequence
  derived and/or modified sequence opt5 from VP1__Norovirus__ACX31837
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgggcucuguga

SEQ ID NO: 26923 - RNA, 1623 nt, Artificial Sequence
  derived and/or modified sequence opt5 from VP1__Norovirus__ACX31841
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcacgccguuuacaccuaaacucggauccguucaguucucuaccgacaccgaaaaugauuuugagacacaucaaaacaccaaguucacacccgugggcgucauucaggacggcagcacgacccaccgcaaugaaccccagcaaugggugcugccuuccuacagcgggagagauguucacaacgugcaucuugccccggccgucgcucccacauuuccuggagagcagcuccuguucuuucggucuaccaugcccggcuguuccggguauccuaauauggaccuggauugccugcucccccaggagugggugcagcacuucuaccaagaagccgcgccugcucagagcgacguggcccugcuucgcuuuguuaaccccgauacaggaagaguccuguucgaguguaaacuccauaagucuggcuaugugaccguggcccacacggggcagcacgaccuggucaucccgccuaauggcuacuuucgguucgauagcugggugaaccaguucuauacccuugcucccaugggaaacggcacagggagacgccgggcccuguga

SEQ ID NO: 26924 - RNA, 1623 nt, Artificial Sequence
  derived and/or modified sequence opt5 from VP1__Norovirus__ACX31851
augaagauggccagcaacgacgcuaaucccuccaacggcucugccgcgaaucuggugccugaggucaacaaugaaguuauggcucucgagccgguggugggggccgccaucgcugcccccgucgcuggacagcaaaacgugauugauccuuggaucagaaauaacuucguucaggcccccggcggggaauuuaccgugagcccucggaaugcgcccggagagauucugugguccgccccucuuggcccggaccugaaccccuaccucucucaccuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcauaucauugucgaugugagacaacucgagccugugcugaucccccugccugacguccggaacaauuuuuaucacuacaaccagucuaacgauagcacaauuaagcucaucgccaugcuguauacaccccuucgcgcuaauaacgccggcgaagacguuuucaccguguccugcagagugcugacccggcccagcccugauuuugacuucauuuuucucgucccgcccacaguggagucucgcaccaaaccuuucacgguucccauccugaccguggaagagaugacaaauuccagauuuccuauuccccuugagaagcuguucaccgggccgagcucugccuucgucgugcagccucagaacggacgguguacaaccgauggcguucuccuggggacgacacaacugucccccgugaauaucugcaccuuucgcggagacgucacacauaucgcuggcagcagaaacuacaccaugaaucucgcgucucugaacuggaauaacuaugauccuaccgaagagauucccgccccucuuggcacacccgacuucguggggaaaauccagggaguccugacgcagaccacaaagggcgauggguccacccggggacacaaggcuacaguguacaccggcagcgccccguuuacgccuaaacucggguccguucaguucucuacagacaccgaaaaugacuuugagacccaucaaaacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaacccggauaccggaagaguccuguucgaguguaaacuccacaagagcggcuaugugacaguggcucauaccgggcagcacgaccuggucaucccucccaauggcuacuuucgguucgauucuugggugaaccaguucuauacgcuugccccuaugggaaauggcaccgggagacgccgggcucuguga

SEQ ID NO: 26925 - RNA, 1623 nt, Artificial Sequence
  derived and/or modified sequence opt5 from VP1__Norovirus__ACX31856
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugaggcccaucaaaauaccaaguucacacccgugggagucauucaggacggcggcaccacacaccgcaacgaaccccagcaaugggugcugccuagcuacuccgggagaaauguuccgaacgugcaccuugcucccgccgucgcgccuacguuucccggagagcagcuccuguucuuucggagcaccaugccuggcuguucuggguaucccaauauggaucuggacugccugcucccucaggagugggugcagcauuucuaccaagaagcugcccccgcccaguccgauguggcucugcuucgcuuuguuaacccggacacaggaagaguccuguucgaguguaaacuccacaagagcggcuaugugaccguggcccauacagggcagcacgaucuggucaucccuucuaacggcuacuuucgguucgacagcugggugaaucaguucuauacccuugcucccaugggaaacggcacggggagacgccggguucuguga

SEQ ID NO: 26926 - RNA, 1623 nt, Artificial Sequence
  derived and/or modified sequence opt5 from VP1__Norovirus__ACX31860
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcggagccuucgucgugcagccucagaauggccgguguacaaccgaugggguucuccugggaacgacacaacugucucccgugaacaucugcaccuuucgcggcgacgucacacauaucgcuggcuccagagauuacaccaugaaucucgcgagccugaacuggaauaacuaugacccuaccgaggaaauucccgccccucuugggacacccgacuucgugggaaaaauccagggcguccugacgcagaccacagagggggauggaucuacccggggccacaaggcuacaguguacaccggguccgccccguuuacgccuaagcucggaagcguucaguucuccacagacaccgaaaaugauuuugagacccaucaaaacacaaaauucacccccgugggcgucauucaggacggcucuacaacgcaccgcaaugaaccccagcaaugggugcugccuagcuacuccgggagaaacguucacaaugugcaucuugccccggcugucgcccccaccuuuccuggagagcagcuccuguucuuucggagcacaaugcccggcuguucuggguauccuaacauggaucuggacugccugcucccccaggagugggugcagcacuucuaccaagaagcggcuccugcccaguccgauguggcccugcuucgcuuuguuaaucccgacaccggaagaguccuguucgaguguaagcuccauaaaagcggcuaugugacaguggcucacaccgggcagcacgaucuggucaucccgccuaacggcuacuuucgguucgacucuugggugaaccaguucuauacgcuugcccccaugggaaauggcaccgggagacgccgggcucuguga

SEQ ID NO: 26927 - RNA, 1623 nt, Artificial Sequence
  derived and/or modified sequence opt5 from VP1__Norovirus__ACX31864
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggauaugaaccccuaccugagccaccucgcccgcauguauaauggguacgcuggaggcuucgaaguccaggugauccuggccggcaacgcuuuuacggccgggaaaauuaucuucgcggccguuccucccaauuuuccuaccgagggacuuucccccucucaggugacaauguucccgcauaucauugucgacgugagacaacuggagccugugcucaucccccugccugauguccggaacaauuuuuaucacuacaaccagagcaaugaccccaccauuaagcugaucgcuaugcucuauacaccccugcgcgccaacaacgcuggcgaugacguuuucaccguguccugcagagugcuuacacggccuagcccggauuuugacuucauuuuucuggugcccccuaccgucgaaucucgcacgaaacccuucuccguuccuauccucaccguggaggaaaugacaaauagcagauuucccauuccgcuggagaaacuuuucaccgggccuucuuccgccuucgucgugcagccccagaacggacgguguacaaccgauggcguucugcucgggacgacacaacugagcccugugaauaucugcaccuuucgcggagacgucacacauaucgccggcucuagaaacuacaccaugaaucuggcuucccagaacuggaauagcuaugaucccaccgaggaaauuccugcgccccucggcacaccggacuucguggggaagauccagggaguccugacgcagaccacacggaccgacggcuccacacgcgggcacaaggccaccguguacacgggaucugcugauuuuagcccuaaacuuggcagaguucaauucgccacagacaccgauaacgacuuuguggccaaucagaacaccaaguucacacccgucggggugauucaggauggaaauaccgcucaucggaacgagccccaacaguggguucugccuuccuacagcggccgcaauacacacaacgugcaccucgccccggcggucgcucccacguuuccuggcgaacagcugcuuuucuuuagaucuaccaugcccggguguuccggauauccuaauauggaccuggauugccuccugccccaggagugggugcaauacuucuaucaggaagccgccccugcucagagcgacguggcccugcuccgguuuguuaaccccgauacaggcagaguccuguucgaguguaaacuucauaagucuggguacgugaccguggcucacacaggacagcaugaccuggucaucccgccuaacggcuauuuucgcuucgauagcugggugaaucaauucuacacccucgcccccauggggaacggcacgggacggagacgcgcgcuguga

SEQ ID NO: 26928 - RNA, 1623 nt, Artificial Sequence
  derived and/or modified sequence opt5 from VP1__Norovirus__ACX31889
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggauaugaaccccuaccugagccaccucgcccgcauguauaauggguacgcuggaggcuucgaaguccaggugauccuggccggcaacgcuuuuacggccgggaaaauuaucuucgcggccguuccucccaauuuuccuaccgagggacuuucccccucucaggugacaauguucccgcauaucauugucgacgugagacaacuggagccugugcucaucccccugccugauguccggaacaauuuuuaucacuacaaccagagcaaugaccccaccauuaagcugaucgcuaugcucuauacaccccugcgcgccaacaacgcuggcgaugacguuuucaccguguccugcagagugcuuacacggccuagcccggauuuugacuucauuuuucuggugcccccuaccgucgaaucucgcacgaaacccuucuccguuccuauccucaccguggaggaaaugacaaauagcagauuucccauuccgcuggagaaacuuuucaccgggccuucuuccgccuucgucgugcagccccagaacggacgguguacaaccgauggcguucugcucgggacgacacaacugagcccugugaauaucugcaccuuucgcggagacgucacacauaucgccggcucuagaaacuacaccaugaaucuggcuucccagaacuggaauagcuaugaucccaccgaggaaauuccugcgccccucggcacaccggacuucguggggaagauccagggaguccugacgcagaccacacggaccgacggcuccacacgcgggcacaaggccaccguguacacgggaucugcugauuuuagcccuaaacuuggcagaguucaauucgccacagacaccgauaacgacuuugaugccaaucagaacaccaaguucacacccgugggggucauucaggacggaaauaccgcucaucggaacgagccccaacagugggugcugccuuccuacagcggccgcaauacacacaacguucaccucgccccggcgguggcucccacguuuccuggcgaacagcugcuuuucuuuagaucuaccaugcccggguguuccggauauccuaauauggaucuggacugccuccugccccaggaguggguccaauacuucuaucaggaagccgccccugcucagagcgauguggcccugcuccgguuugugaaccccgacacaggcagaguucuguucgaguguaaacuucauaagucuggguacgucaccguggcucacacaggacagcaugaucuggugaucccgccuaacggcuauuuucgcuucgacagcugggucaaucaauucuacacccucgcccccauggggaacggcacgggacggagacgcgcgcuguga

SEQ ID NO: 26929 - RNA, 1608 nt, Artificial Sequence
  derived and/or modified sequence opt5 from VP1__Norovirus__ACX31893
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaacagcgcaugagacuggucgccaugcucuacacaccucugcgguccaauggcucuggggaugacguuuucaccgugagcugccgcgugcugacaagacccucccccgauuuugacuucaacuaucucgucccuccgaccguggagagcaagacgaaacccuuuacccugccuauccuuacaauuggagagcugaccaauucucgguuccccguuccuaucgaugaacucuacacaucccccaacgagagccuggugguccagccgcagaauggccgcugugcucuugacggggaacugcaaggaaccacgcagcuccugccuacagccauuugcucuuuuagaggccggaucaaccagaagguguccggcgagaaucacguuuggaacaugcaagugaccaauauuaacgggacacccuucgauccuaccgaagacguccccgcuccucugggaacccccgauuucagcggcaaacucuuuggggugcugucucagcgcgaccaugacaaugccuguagaucccacgaugccgucaucgcuacaaacagcgcgaaguucacgccgaaacuuggagccauucagaucggcaccugggagcaggacgaugugcacaucaaucaaccuacaaaguuuacccccguugggcuguucgaguccgaaggauuuaaccaguggacacuccccaauuauucuggcgcucugacccuuaacaugggccuggccccuccgguggcccccacguucccuggggagcagauucucuuuuuccggagccauaucccccugaagggaggcgucgcugacccugugauugauugccugcucccccaggaauggauccaacaccuguaccaggaguccgccccuagccagacagacguugcgcuuauucgcuuuaccaaccccgauaccgggagagugcuguucgaagcuaaacuccaucggucuggauacaucacagucgccaauaccggcuccagaccgaucguggugccugccaacggguauuuucgcuucgacagcuggguuaaucaguuuuacucucuggcucccaugggcacaggaaacggccggagacgcguccaauga

SEQ ID NO: 26930 - RNA, 1749 nt, Artificial Sequence
  derived and/or modified sequence opt5 from VP1__Norovirus__ACX69259
augaagauggccagcaacgacgcugcgcccccuuccucugauggcgccgcuaaucuggugccggagaucaacaaugaagucauggcccucgagcccguugccggggcucagcuggccgcuccuguggccggacaauucaacgcgauugaccccuggaucagacagaauuuugugcaggccccugaaggcgaguucaccgucagcccccggaacgcuccuggggaaauucuucugaaucucgagcugggaccgcaccuuaaccccuuucugcagcaucucgcccaaauguacaaugcuuaugccggcgggauggaggugcagguugugcuggcgggaaacgccuucacagcuggcaaaaucauuuuugccgcuaucccuccccacuucccucccgaacgccuguccgccgcccaggcuacgcaguuuccgcaugucaucguggauguuagacaacucgagccuauugugcugccccuuccugacguccggcacaaucuguuccauuuuaaccagcagaaugaugaacgcaugcaccucguggcguuccuguacacaccccuuagagccaacucuggcaauggggacgauguguuuaccgucagcugccggguucugacccgccccucccaggacuucgaguuuauguuccucgugccuccgacaguggagaagaaaaccgucgcuuucucucugccccaacuggccgugggagaaaugagcaacuccagauggccugcccggaucacaggcaugguuguggauccccgccucccucagguccugcacauucagaacgggagauguacccuugacggaacgcugaugggcaccacacaacucaaucccaacgauaucugccggauucgcggguauuuuucuagcuccagaccggagcugcuuugugaaggagaggaaagcgaggugaauaccacaccuaccgacucuggcgcuacgggcgaucagacacccgagguucggaccgggacacgcgccacccagagaugguucgcggugaccgaacugaacggacaggucuacgacccuuuuggcgaccaacccgcuccucucggggugcccgauuucaaggcccggauccugggagcccugaugagacucccgggcacaaauccuacguccaacagccgcuuugaggacgcuugggucgaaaccaauaaccagacaaccuaugcccccgcuacaggggugguugccauuaccacgaaugauaacucuuccggaaauuacgcgaacgaccagacaugcgaguucgugccccugggcaucgaaaucaccgauagcgccccuuauaaugaguuugaccuuccguccuacggcggggcugccucuagcggaaaccggaaucuggcucccaccgucgccccuacauuccccggcgaggcgauucuccuguuuggguccaacaugccuguguacaacagaagcucuggaaccgauaauaaagacauccgcugucuucugcccaacgaauauguucagcaucucuacgauacacaagccccuucccugagcgacguggcucugguccgguaugugaauagagauacgggccgcguucucuucgaggccaagcugcaccgggacggguuuaugaccgugaacgcuucuagcacaaccguccuucccguggacggcuacuucagauuugauuccugggugaaucaguucuaugcccugucuccggucggaaacgccagcggccgccgggggagaucccgccaggcuaauuga

SEQ ID NO: 26931 - RNA, 1647 nt, Artificial Sequence
  derived and/or modified sequence opt5 from VP1__Norovirus__ADF47131
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuugucgccaugcuguacacaccccucagagcuaauaacuccggggaugacguguucaccgugucuugucggguccugacacgcccuagccccgauuuuuccuucaauuuucuuguucccccuaccguggagagcaagacaaaaccguucacccugcccauucucacgaucucugaaauguccaacagcagauuuccugugcccauugacucucugcauaccuccccuacagagaauaucgucgugcagugccagaacggacggguuacccuggauggcgagcucauggggacaacccaacugcuucccagccagaucugugcguuccgcggagugcugacgagaucuacaucccgggccagcgaccaggcugauaccgccacaccgcgccucuucaauuauuacuggcacauucagcuggacaaccuuaauggcaccccuuaugaccccgccgaagauaucccuggcccccuggggaccccugacuuuagaggaaaggucuucggcguggcuucccaacggaaccccgauucuacaacgcgcgcccaugaggcgaaaguugacaccacagcugggagauuuaccccgaagcucggaagccuggaaauuuccacagagagcggcgauuucaaucagaaccagccuacccgguuuacgcccguggggaucggagucgaccacgaagaggauuuccaacaguggucucugcccgacuacuccggccaguuuacacacaauaugaaccucgccccugccguggcuccgaauuuccccggcgagcagcugcuguuuuucagaagccaacuuccuucuagcgggggacgcuccaacggcauucucgauugccuggucccccaggaaugggugcagcauuuuuaccaggagucugccccuacccaaacccagguugcucuugugcgguaugucaaccccgacacagggagagugcuguucgaagccaagcuccacaaacugggauuuaugaccaucgcgaagaauggcgauagcccuaucacaguucccccgaacggguacuuccgcuucgaguccugggugaauccuuuuuauacgcuggcccccaccggcacagaaaacggacggagacgcguccaguga

SEQ ID NO: 26932 - RNA, 1623 nt, Artificial Sequence
  derived and/or modified sequence opt5 from VP1__Norovirus__ADR78869
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggagacgccgggcucuguga

SEQ ID NO: 26933 - RNA, 1623 nt, Artificial Sequence
  derived and/or modified sequence opt5 from VP1__Norovirus__ADR78872
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucuccggcagcagaaauuacaccaugaaccucgcuucucugaauuggaacaauuaugacccuaccgaagagauucccgcgccucuugggacacccgauuucgugggaaaaauccagggcguccugacgcagaccacaaagggggacggauccacccggggccacaaggccacaguguacaccgggagcgcuccguuuacgccuaaacucggauccguucaguucucuacagacaccgaaaacgauuuugagacccaucaaaauacaaaguucacccccgugggcgucacacaggacggcagcacgacccaccgcaacgaaccccagcaaugggugcugccuuccuacagcgggagaaauguucacaacgugcaucuugccccggccgucgcucccacauuuccuggagagcagcuccuguucuuucggucuaccaugcccggcuguuccggguauccuaauauggaucuggacugccugcucccccaggagugggugcagcacuucuaccaagaagccgcgccugcucagagcgauguggcccugcuucgcuuuguuaaccccgacacaggaagaguccuguucgaguguaaacuccauaagucuggcuaugugaccguggcccacacggggcagcacgaucuggucauuccgccuaacggcuacuuucgguucgacagcugggugaaucaguucuauacccuugcucccaugggaaacggcacagggagacgccgggcccuguga

SEQ ID NO: 26934 - RNA, 1623 nt, Artificial Sequence; identical to SEQ ID NO: 26932
  derived and/or modified sequence opt5 from VP1__Norovirus__ADR78875

SEQ ID NO: 26935 - RNA, 1623 nt, Artificial Sequence; identical to SEQ ID NO: 26932
  derived and/or modified sequence opt5 from VP1__Norovirus__ADR78878

SEQ ID NO: 26936 - RNA, 1623 nt, Artificial Sequence; identical to SEQ ID NO: 26932
  derived and/or modified sequence opt5 from VP1__Norovirus__ADR78881

SEQ ID NO: 26937 - RNA, 1623 nt, Artificial Sequence; identical to SEQ ID NO: 26932
  derived and/or modified sequence opt5 from VP1__Norovirus__ADR78884

SEQ ID NO: 26938 - RNA, 1623 nt, Artificial Sequence
  derived and/or modified sequence opt5 from VP1__Norovirus__ADR78887
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugagccucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgggcucuguga

SEQ ID NO: 26939 - RNA, 1623 nt, Artificial Sequence; identical to SEQ ID NO: 26932
  derived and/or modified sequence opt5 from VP1__Norovirus__ADR78890

SEQ ID NO: 26940 - RNA, 1623 nt, Artificial Sequence; identical to SEQ ID NO: 26932
  derived and/or modified sequence opt5 from VP1__Norovirus__ADR78893

SEQ ID NO: 26941 - RNA, 1623 nt, Artificial Sequence; identical to SEQ ID NO: 26932
  derived and/or modified sequence opt5 from VP1__Norovirus__ADR78896

SEQ ID NO: 26942 - RNA, 1623 nt, Artificial Sequence
  derived and/or modified sequence opt5 from VP1__Norovirus__ADR78899
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuuggggcucccgauuucgugggaaaaauccagggcguccugacacagacgaccaagggggacggaucuacacggggccacaaggccaccguguacacaggguccgccccguuuaccccuaaacucggaagcguucaguucuccacggacacagaaaacgauuuugagacccaucaaaauaccaaguucacacccgugggcgucauucaggacggcucuaccacacaccgcaacgaaccccagcaaugggugcugccuagcuacuccgggagaaauguucacaacgugcaucuugcuccggccgucgcgcccacguuuccuggagagcagcuccuguucuuucggagcaccaugcccggcuguucuggguauccuaauauggaucuggacugccugcucccccaggagugggugcagcacuucuaccaagaagcugccccugcccaguccgauguggcucugcuucgcuuuguuaaccccgacacaggaagaguccuguucgaguguaaacuccauaagagcggcuaugugaccguggcccacacagggcagcacgaucuggucaucccgccuaacggcuacuuucgguucgacucuugggugaaucaguucuauacccuugcucccaugggaaacggcacggggagacgccgggcccuguga

SEQ ID NO: 26943 - RNA, 1623 nt, Artificial Sequence; identical to SEQ ID NO: 26932
  derived and/or modified sequence opt5 from VP1__Norovirus__ADR78902

SEQ ID NO: 26944 - RNA, 1623 nt, Artificial Sequence; identical to SEQ ID NO: 26932
  derived and/or modified sequence opt5 from VP1__Norovirus__ADR78905

SEQ ID NO: 26945 - RNA, 1623 nt, Artificial Sequence
  derived and/or modified sequence opt5 from VP1__Norovirus__ADR78908
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucacaacgugcaucuugccccggcugucgcccccaccuuuccuggggagcagcuccuguucuuucggucuacaaugcccggauguuccggcuauccuaauauggaucuggacugccugcucccccaggagugggugcagcacuucuaccaagaagcggcuccugcccagagcgauguggcccugcuucgcuuuguuaaccccgacaccgggagaguccuguucgaguguaaacuccauaagucuggauaugugacaguggcucacaccggccagcacgaucuggucaucccgccuaacggguacuuucgguucgacagcugggugaaucaguucuauacgcuugcccccaugggcaacggaaccggcagacgccgggcucuguga

SEQ ID NO: 26946 - RNA, 1623 nt, Artificial Sequence
  derived and/or modified sequence opt5 from VP1__Norovirus__ADR78911
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcagcucucuaccgauacaagcaaugacuucgagaccgggcagaacacaagauuuacgcccgucggagugguucaagauggcuccaccacacaccagaaugaaccccagcagugggugcugccugacuacagcggccgggauucucacaacguccaucuugcuccggccguggcccccaccuucccuggggagcaacugcucuuuuuccgcuccacaaugcccggauguagcggcuacccuaauaugaaccuggacugccugcucccccaggaaugggugcagcacuuuuaucaggagucugcuccugcccaaagcgauguugcgcugcuuagauucgucaaucccgacaccgggcgggugcuguuugaguguaaacuccauaaguccggauacgugacggucgcucacaccggccagcacgaucuggugauuccgccuaacggguauuucagauuugacucuuggguuaaccaguucuacacacuugcccccaugggcaauggagccggccgccggagagcucuguga

SEQ ID NO: 26947 - RNA, 1623 nt, Artificial Sequence
  derived and/or modified sequence opt5 from VP1__Norovirus__ADR78914
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguugcgcuccugagauuugucaaucccgacaccgggcgggugcuuuucgaguguaaacugcauaaguccggauacgugacggucgcucacaccggccagcacgaucucgugauuccgccuaacggguauuuuagauucgacucuuggguuaaccaguucuacacacuggcccccaugggcaauggagccggccgccggagagcucuuuga

SEQ ID NO: 26948 - RNA, 1623 nt, Artificial Sequence
  derived and/or modified sequence opt5 from VP1__Norovirus__ADR78917
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggagaauccagggaguccuuacacaaaccacacggcgcgacggcucuaccagagggcacaaagccacgguguccacaggaagcguucauuuuaccccuaagcugggcuccgugcaguucucuaccgauacaagcaaugacuuugagaccgggcagaacacacgguucacgcccgucggagugguucaagauggcuccaccacacaccagaaugaaccccagcagugggugcucccugacuacagcggccgcgauucucacaacguccaucuggcuccggccguggcccccaccuuuccuggggagcaacuucuguucuuuagauccacaaugcccggauguagcggcuacccuaauaugaaccucgacugccugcugccccaggaaugggugcagcacuucuaucaggagucugcuccugcccaaagcgauguugcgcuccugcgguuugucaaucccgacaccgggagagugcuuuucgaguguaagcugcauaaauccggauacgugacggucgcucacaccggccagcacgaucucgugauuccgccuaacggguauuuucgcuucgacucuuggguuaaccaguucuacacacuggcccccaugggcaauggagccggccggagacgcgcucuuuga

SEQ ID NO: 26949 - RNA, 1623 nt, Artificial Sequence
  derived and/or modified sequence opt5 from VP1__Norovirus__ADR78920
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcgacaccacacaccagaaugaaccccagcagugggugcucccugauuacuccggccgggacagccacaacguccaucuggcuccggccguggcccccaccuuuccuggggagcaacuucuguucuuucgcucuacaaugcccggauguuccggcuacccuaauaugaaccucgauugccugcugccccaggaaugggugcagcacuucuaucaggagagcgcuccugcccaaucugacguugcgcuccugagauuugucaaucccgauaccgggcgggugcuuuucgaguguaaacugcauaagagcggauacgugacggucgcucacaccggccagcacgaccucgugauuccgccuaacggguauuuuagauucgauuccuggguuaaccaguucuacacacuggcccccaugggcaauggagccggccgccggagagcucuuuga

SEQ ID NO: 26950 - RNA, 1623 nt, Artificial Sequence
  derived and/or modified sequence opt5 from VP1__Norovirus__ADR78923
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaagacgggacggcuccacccgcgggcacaaggccacggugagcacaggauccguucauuuuaccccgaagcugggcucugugcaguucagcaccgauacauccaaugacuuugagaccgggcagaacacaagauucacgccugucggagugguucaagauggcagcaccacacaccagaaugaaccccagcagugggugcuccccgacuacucuggccgggauucccacaacguccaucuggcuccugccguggccccgaccuuucccggggagcaacuucuguucuuucgcagcacaaugccuggauguucuggcuaccccaauaugaaccucgacugccugcugccucaggaaugggugcagcacuucuaucaggagagcgcucccgcccaauccgauguugcgcuccugagauuugucaauccugacaccgggcgggugcuuuucgaguguaaacugcauaagucuggauacgugacggucgcucacaccggccagcacgaucucgugauucccccgaacggguauuuuagauucgacagcuggguuaaccaguucuacacacuggccccuaugggcaauggagccggccgccggagagcucuuuga

SEQ ID NO: 26951 - RNA, 1623 nt, Artificial Sequence
  derived and/or modified sequence opt5 from VP1__Norovirus__ADR78929
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccagaacauaccggaugaaccucgccucccagaauuggaacaauuaugauccuacggaggaaauucccgcuccucugggcacccccgacuucguggggaaaauccagggaaugcuuacacagaccacaaagggcgacgggagcacccgcggacacaaggcgacggucuccacaggcucuguggauuuuaccccgaaacuggggagcguucaauucgccaccgacacagauaacgacuuugagaccggacagaauacaagauucacgccugugggcgucauucaggauggcuccagcgcucaucggaacgaaccccaacagugggugcuccccgacuacucugggcgcaccguucacaaugugcaccuggccccugccgucgcuccgacauuucccggagagcagcuucuguucuuuagauccaccaugccuggcuguagcggguaccccaacauggaucucgacugccugcugccucaggaaugggugcaacauuucuaucaggaggccgcgcccucucagagcgauguggcucuccugcgguuuguuaauccugacacaggaagaguccuuuucgaguguaagcugcacaaagccggcuacgugaccguggcccauacggggcagcacgaucucgucauucccccgaacggcuauuuucgcuucgacuccugggugaaucaauucuacacccuggcuccuaugggaaacggcgccgggcggagacgcgcucuuuga

SEQ ID NO: 26952 - RNA, 1623 nt, Artificial Sequence
  derived and/or modified sequence opt5 from VP1__Norovirus__ADR78932
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaugacguuuucaccgugucuugcagagugcugacccggcccuccccugauuuugacuucauuuuucucgucccgcccacaguggaaagccgcaccaaaccuuucacgguucccauccugaccguggaggaaaugacaaacucuagauuuccuauuccccuugagaagcuguucaccgggccguccagcgccuucgucgugcagccucagaauggacgguguacaaccgauggcguucuccuggggacgacacaacugucucccgugaacaucugcaccuuucgcggagacgucacacauaucuccggcagcagaaauuaccggaugaaccucgcuucccagaauuggaacaauuaugauccuaccgaggaaauucccgcgccucugggcacccccgacuucguggggaaaauccagggaaugcuuacacagacgaccaagggcgacgggucuacacgcggacacaaggccaccgucagcacaggcuccguggauuuuaccccgaaacuggggagcguucaauucgcuacggacacagauaacgacuuugagaccggacagaauaccagauucacaccugugggcgucauucaggaugggucuuccgcccaucggaacgaaccccaacagugggugcuccccgacuacagcggccgcaccguucacaaugugcaccuggccccugcugucgccccgacauuucccggagagcagcuucuguucuuuagaucuacgaugccuggcuguagcggguaccccaacauggaucucgacugccugcugccucaggaaugggugcaacauuucuaucaggaggcggcucccucccagucugauguggcccuccugcgguuuguuaauccugacaccggaagaguccuuuucgaguguaagcugcacaaagccggcuacgugacaguggcucauaccgggcagcacgaucucgucauucccccgaacggcuauuuucgcuucgacagcugggugaaucaauucuacacacuggccccuaugggaaacggcgcugggcggagacgcgcccuuuga

SEQ ID NO: 26953 - RNA, 1623 nt, Artificial Sequence
  derived and/or modified sequence opt5 from VP1__Norovirus__ADR78938
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaucuuaccggaugaaccucgccucccagaauuggaacaauuaugaucccacagaggaaauuccugcuccccugggcacgccggacuucguggggaaaauccagggaaugcuuacccagacaaccaagcgcgacggcagcacaagagggcacaaggcgaccgucuccacgggaucuguggauuuuacaccuaaacugggcagcguucaauucgccaccgacaccgauaacgacuuugagacagggcagaauacccgguucacacccgugggagucauucaggauggcuccagcacgcaucgcaacgaaccccaacagugggugcucccugacuacucuggcagaaccguucacaaugugcaccuggcuccggccgucgcccccacauuuccuggggagcagcuucuguucuuucgguccaccaugcccggauguagcggcuacccuaacauggaucucgacugccugcugccccaggaaugggugcaacauuucuaucaggaggcugccccuucucagagcgauguggcgcuccugagauuuguuaaucccgacacagggcgcguccuuuucgaguguaagcugcacaaagcuggauacgugaccguggcccauacgggccagcacgaucucgucaucccgccuaacggguauuuucgguucgacuccugggugaaucaauucuacacccuggcccccaugggcaacggagcuggcagacgccgggcccuuuga

SEQ ID NO: 26954 - RNA, 1623 nt, Artificial Sequence; identical to SEQ ID NO: 26795
  derived and/or modified sequence opt5 from VP1__Norovirus__ADR78941

SEQ ID NO: 26955 - RNA, 1623 nt, Artificial Sequence
  derived and/or modified sequence opt5 from VP1__Norovirus__ADR78944
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcuccagaaccuaccggaugaaccucgccagccagaauuggaacaauuaugauccuacagaggaaauucccgcuccucugggcacgcccgacuucguggggaaaauccagggaaugcuuacccagacaaccaagggcgacggguccacacgcggacacaaggcgaccgucucuacgggcagcguggauuuuacaccgaaacugggguccguucaauucgccaccgacaccgauaacgacuuugagacaggacagaauaccagauucacaccugugggcgucauucaggauggcagcucuacgcaucggaacgaaccccaacagugggugcuccccgacuacuccgggcgcaccguucacaaugugcaccuggcuccugccgucgccccgacauuucccggagagcagcuucuguucuuuagaagcaccaugccuggcuguucuggguaccccaacauggaucucgacugccugcugccucaggaaugggugcaacauuucuaucaggaggcugcccccagccaguccgauguggcgcuccugcgguuuguuaauccugacacaggaagaguccuuuucgaguguaagcugcacaaagcuggcuacgugaccguggcccauacggggcagcacgaucucgucauucccccgaacggcuauuuucgcuucgacucuugggugaaucaauucuacacccuggccccuaugggaaacggcgcugggcggagacgcgcccuuuga

SEQ ID NO: 26956 - RNA, 1623 nt, Artificial Sequence; identical to SEQ ID NO: 26795
  derived and/or modified sequence opt5 from VP1__Norovirus__ADR78947

SEQ ID NO: 26957 - RNA, 1623 nt, Artificial Sequence
  derived and/or modified sequence opt5 from VP1__Norovirus__ADR78950
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugcuucuggcuggcaacgccuuuacagcggggaaaaucauuuucgccgcuguuccucccacguuuccuaccgagggacucucccccucucaggugacaauguucccgcauaucaucgucgacgugagacaacuggagccugugcugauuccccucccugauguccggaauaacuuuuaucacuacaaucagagcaacgacuccaccaucaagcugguugccaugcuuuauacaccccugcgcgcuaauaacgccggcgaugacguguucaccgugagcugcagaguccucacacggcccucuccugauuuugacuucauuuuucuggugccgcccaccguugaaucccgcacgaaaccuuucaccgugcccauccuuacagucgaggaaaugaccaacagcagauuuccuauuccccuggagcggcuguucacagggccgucuuccgccuucgugguucagccucagaauggacgcuguaccacggauggcgugcugcuggggacaacccaacucagccccgucaacaucugcacauuuagaggagacgugaccaauauuccuggcucucggaccuaccgcaugaaccuggcuucccagaauuggaacaauuaugaucccacagaggaaaucccugcgccccuuggcacgccggacuucgucgggaagauccagggagugcugacccagacaaccaaaggcgacgggagcacaagaggacauaaggccaccguucggacgggcuccgcugauuuuacaccuaagcucgggucugugcaauucgccaccgacaccgauaacgacuuugucacaggacagaauacccgcuucacacccgugggcguuauucacgauggcagcuccgcccauagaaacgagccccagcaaugggugcugccugaauacagcgggcggucuguccacaaugugcaccuugcuccggccguggcgcccacguuuccuggagagcagcuccucuucuuuagauccaccaugcccggcuguagcggguacccuaacauggaccuggauugccugcucccccaggaauggguucagcauuucuaucaagaggcugccccuucucagagcgacgucgcccugcuucgcuuugugaaucccgauacaggacgggugcuguucgaguguaaacuccacaaggcuggcuacgucaccguggcccauacagggcagcacgaccugguuaucccgccuaacggcuauuuuagauucgauuccugggugaaucaguucuacacccuugcucccaugggaaacggcgccgggcgccggagagcgcuguga

SEQ ID NO: 26958 - RNA, 1623 nt, Artificial Sequence
  derived and/or modified sequence opt5 from VP1__Norovirus__ADR78956
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccgcucaucggaacgaaccccaacagugggugcucccugacuacagcgggcgcaccguucacaaugugcaccuggccccggccgucgcucccacauuuccuggagagcagcuucuguucuuuagaucuaccaugcccggcuguuccggguacccuaacauggaucucgacugccugcugccccaggaaugggugcaacauuucuaucaggaggccgcgccugcucagagcgauguggcccuccugcgguuuguuaaucccgacacaggaagaguccuuuucgaguguaagcugcacaaaaccggcuacgugacgguggcccauaccgggcagcacgaucucgucaucccgccuaacggcuauuuucgcuucgacucuugggugaaucaauucuacacacuggcucccaugggaaacggcgccgggcggagacgcgcucuuuga

SEQ ID NO: 26959 - RNA, 1653 nt, Artificial Sequence
  derived and/or modified sequence opt5 from VP1__Norovirus__AEA02124
augaugauggccagcaaggacgcuaccuccaacauggauggcacaucuggggccggacagcuggugcccgagaauaacaauacgagcgaaccuaucaacauggagccggucgcgggcgcuguuaccgccgccgcuacagccgggcaagugaauaugauugaccccuggaucaugaacaauuacgugcaggcuccucagggagaguucaccauuucccccaacaauacaccuggcgauauccucuuugaccugcagcuugggccccaccugaacccuuuccucgcccaucugucucaaauguauaauggaugggucggcaacaugaaagugagaguugugcuugcgggcaaugccuuuagcgcugggaagauuaucgucugcuguaucccgcccggauucuccgccccuaacauuucuaucgcucaggccaccauguuuccccacgugauugcggauguucgggugcuggaaccuaucgacauuccccucgaugacguccgcaaugugcuguuccauacaaacgauaacggcaaucagaccaugagacugcucugcaugcuguacacgccgcuucggagcgggggaaccuccagcggcacagacccuuuugugaucgccgggcgcguccugaccugucccacaccugauuucaacuuucucuuccugguuccucccaccguggaacagaaaacgaagcaauuuucugugcccaaucuuccgcugaacgucauguccaauagcagagugcccucucuccugaacgcuaugguuguguccccugaccaggcccaggucgugcaguuccaaaauggacggugcacacuggauggccagaugcucggcaccacaaccguuagcgcuucuuguguggcccgcuuuagagggaaaaccuuccaggcccccgacaaccggcugggaauuaaucuugcugagaucuccggcgagccuuaucacgcguucgaaagccccgccccgcugggguuuccugacuucggagauggcgacuggcaugucacagcuacgaaggugacccccucccaacucgaggccaacgauccugucgugguugggaaugugcagcccuacaacccucaguuugcuccccaccugggaacacuugucguggaaaauccgaccccugaccagguugccacaggcaccgaucuccuguucaacaucacguggcugucuaaucgcgccaacaacagauuuaaucccugggugauucccaacuauggcagcacacugaccgaggcggcucaacucgccccuuccaucuucccgcccggguuuggagagaccauugucuacuucaauagcacauuuccugccgugggcgcuaccacacacgccgcuauccccugccugcuuccucaggaguucguggcccauuuuguuaacgaacaggcgcccauucgcggggaagccgcucugcuccacuauaucgacccugauacgcaucggaaucugggagaguucaagaucuaccccgaaggcuuugucaccugugugccgaacgucgggggcacaggaccucagucucuucccaccaauggcguguucguguucguuuccugggugagcagauacuaucaacugaaaccugucgggacagccggacaggcucggcgccucggcuuuagacggguguga

SEQ ID NO: 26960 - RNA, 1647 nt, Artificial Sequence
  derived and/or modified sequence opt5 from VP1__Norovirus__AED02033
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccauugauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucacccugcccauccucacgauuucugaaauguccaacagcagauuuccugugcccaucgacucucugcauaccuccccuacagagaauaucgugguccagugccagaacggacgggugacccuggauggcgagcucauggggacaacccaacugcuucccagccagauuugugcguuccgcggaacgcugaucagaucuacaucccgggccagcgaccaggcugauaccuccacaccgcgccucuucaauuauuacuggcacauucagcuggacaaccuuaauggcaccccuuaugaccccgccgaagauaucccugcuccccugggcaccccugacuuuagagggaagguuuucggaguggccucucaacggaaccccgauagcacaacgcgcgcccaugaggcgaaagucgacaccacauccggcagauuuaccccgaagcucgggagccuggaaauuaucacagagucugaugacuucgaucugaaucaguccaccaaguuuacgccugugggaaucggcguugacaacgaagcugaguuccagcaauggagccuccccaauuacucugggcaguuuacacacaacaugaaucuggcccccgccguggcuccuaacuucccgggagagcagcuucuguuuuuccggagccagcuccccuccucuggcggcagaagcaacgggguccuggauugccuugugccucaagaauggguccagcacuuuuaccaggaguccgcccccgcucagacccaaguggcccugguucgcuaugugaauccugacaccggacggguccucuucgaagcgaaacugcauaagcugggcuuuaugacaauugccaaaaacggggauagccccaucaccgugccucccaauggauacuucagauucgagucuuggguuaacccguuuuauacacucgcuccuaugggcacggggaauggccgccggagaauccaguga

SEQ ID NO: 26961 - RNA, 1647 nt, Artificial Sequence
  derived and/or modified sequence opt5 from VP1__Norovirus__AED02034
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuugugcccccuaccguugagagcaagacaaaaccguucacccugcccauccucacgauuucugaaauguccaacagcagauuuccugugcccaucgacucucugcauaccucccugacagagaauaucgugguccagugccagaacggacgggugacccucgauggcgagcugauggggacaacccaacuucugccuagccagauuugugcguuccgcggaacgcucacaagaucuaccucccgggccagcgaccaggcugauacagccacaccccgccuguucaauuauuacuggcacauccagcuuaacaaucugaacggcaccccguaugacccugccgaagacauucccgcuccucucggcacccccgauuuuagagggaagguuuucggaguggccucccaacggaauccugacucuacgacccgcgcgcaugaggcuaaagucgauacaaccagcggcagauuugcccccaagcuggggucccuggaaaucagcacagagaccgacgauuucaaccagaaucagccgacgcgguuuacaccugugggaauuggcguugacaacgaagccgauuuccaacaguggucucuccccgacuacuccgggcaguuuacccacaauaugaaccuggcucccgccguggcuccuaacuucccgggagagcagcuucuguuuuucagaagccaacuccccucuagcggcggccgcuccucugggauccuggauugccuugucccucaggagugggugcagcacuuuuaccaggaaagcgcccccgcgcaaacccaggucgcccuggugcgguauguuaauccugacacaggaagaguccucuucgaggcuaagcugcauaaacugggcuuuaugaccaucgccaagaacggggauucccccauuacagucccucccaauggauacuuccgcuucgaaagcugggugaacccguuuuauacgcucgcuccuaugggcaccgggaauggccggagacgcauccaguga

SEQ ID NO: 26962 - RNA, 1647 nt, Artificial Sequence
  derived and/or modified sequence opt5 from VP1__Norovirus__AED02035
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucacccugcccauccucacgauuucugaaauguccaacagcagauuuccugugcccaucgacucucugcauaccuccccuacagagaauaucgugguccagugccagaacggacgggugacccuggauggcgagcucauggggacaacccaacugcuucccagccagauuugugcguuccgcggaacgcugacaagaucuaccucccggacaggcgaccaggccgauaccgcuagcccgcgccucuucaauuauuacuggcacauccagcuggacaaccuuaauggcaccccuuaugaccccgccgaagauauuccugcuccccuggggacaccugacuuuagaggaaagguuuucggcguggccucccaacggaaccccgauucuacgacccgcgcccaugaggcgaaagucgacacaaccagcgggagauuugcuccgaagcucggaucccuggaaaucagcacagagucugaugacuucgauuccaaucagccuacccgguuuacgcccgugggcauugggguugacagagaaacagauuuccagcaauggacccugcccgaguacagcggacaguuuacccacaacaugaaucucgccccugccguggcuccgaacuuccccggcgagcagcugcuguuuuuccgcucucagcuuccuagcuccggcgggcggucuggaggcauccucgacugccuggucccccaagaaugggugcagcacuuuuaccaggagagcgccccugcucagacacaagucgcccuugugagauauguuaaucccgauaccgggcgcgugcuguucgaagcgaagcuccauaaacugggauuuaugacaaucgccaagaacggcgacuccccuauuacggugcccccgaacggguacuuccgguucgagagcugggucaauccuuuuuauacccuggcucccaugggcacaggaaacggcagacgccggauccaguga

SEQ ID NO: 26963 - RNA, 1647 nt, Artificial Sequence
  derived and/or modified sequence opt5 from VP1__Norovirus__AED02037
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccaucgacaaucuguccgcugcccagaucaccaugugcccucaugucauuguggauguucgccaacuggagcccaucaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuacagaaagcaucgugguccagugccagaauggacgggugacccuggacggcgagcucauggggacaacccaacugcuucccaaccagauuugugcguuccgcggaacgcugacaagaucuaccaaucgggccuccgaucaggcugacacagccaccccgcgccucuucaaccaccauuggcacauccagcuggacaaucuuaacggcaccccuuaugaucccgccgaggacauuccugcuccccugggcacaccugauuuuagagggaagguuuucggaguggccagccaacggaaucccgacuccacgacccgcgcgcacgaagcuaaagucgauacaaccucuggcagauuuacaccgaagcucgggagccuggagaucaccacggaauccgacgauuucgacccuaaccagagcacaaaguuuacccccgugggaauuggcguugauaaugaggccgacuuccagcaauggucucugcccgauuacuccgggcaguuuacccauaacaugaaucucgccccugcuguggccccgaacuuccccggagaacagcugcuguuuuuccggagccagcuuccuucuagcggcggcagauccaacgggauccucgacugccuggucccccaagagugggugcagcacuuuuaucaggagucugcuccugcccagacacaagucgcgcuugugcgcuacguuaaucccgacaccggacgggugcuguucgaagccaaacuccauaagcugggcuuuaugacaaucgcuaaaaacggggauagcccuauuacggugcccccgaauggauacuucagauucgaguccugggucaacccuuuuuauacccuggcccccaugggcacagggaauggccgccggagaauccaguga

SEQ ID NO: 26964 - RNA, 1647 nt, Artificial Sequence
  derived and/or modified sequence opt5 from VP1__Norovirus__AED02038
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucacccugcccauccucacgauuucugaaauguccaacagcagauuuccugugcccaucgacucucugcauaccuccccuacagagaauaucgugguccagugccagaacggacgggugacccuggauggcgagcucauggggacaacccaacugcuucccagccagauuugugcguuccgcggaacgcugacaagaucuaccucccgggccggcgaccaggcugauacagccaccccgcgccucuucaauuauuacuggcacauccagcuggacaaccuuaauggcaccccuuaugaccccgccgaagauauuccugcuccccuggggacaccugacuuuagaggaaagguuuucggcguggccagccaacggaaccccgauuccacgacccgcgcgcaugaggcuaaagucgacacaaccucugggagauuugccccgaagcucggaagccuggaaaucuccacagagagcucugauuucgacuccaaucagccuacccgguuuacgcccgugggcauugggguugauaacgaagccgacuuccagcaauggagccugcccgauuacucuggacaguuuacacacaauaugaaccucgcuccugccguggcuccgaauuuccccggcgagcagcugcuguuuuucagaagccagcuuccuuccucuggcgggcgcagcaacggaauccucgacugccuggucccccaagagugggugcagcacuuuuaccaggaauccgccccugcgcagacccaagucgcccuugugcgguauguuaaccccgauaccggcagagugcuguucgaggcuaagcuccauaaacugggguuuaugacaaucgccaagaauggagacagcccuauuaccgugcccccgaacggcuacuuccgcuucgaaucuugggucaauccuuuuuauacacuggcucccauggggacgggcaacggacggagacgcauccaguga

SEQ ID NO: 26965 - RNA, 1647 nt, Artificial Sequence
  derived and/or modified sequence opt5 from VP1__Norovirus__AED02039
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucacccugcccauccucacgauuucugaaauguccaacagcagauuuccugugcccaucgacucucugcauaccuccccuacagagaauaucgugguccagugccagaacggacgggugacccuggauggcgagcucauggggacaacccaacugcuucccagccagauuugugcguuccgcggaacgcugacaagaucuaccucccgggccggcgaccaggcugauacagccaccccgcgccucuucaauuauuacuggcacauccagcuggacaaccuuaauggcaccccuuaugaccccgccgaagauauuccugcuccccuggggacaccugacuuuagaggaaagguuuucggcguggccagccaacggaaccccgauuccacgacccgcgcgcaugaggcuaaagucgacacaaccucugggagauuugccccgaagcucggaagccuggaaaucuccacagagagcucugauuucgacuccaaucagccuacccgguuuacgcccgugggcauugggguugauaacgaagccgacuuccagcaauggagccugcccgauuacucuggacaguuuacacacaauaugaaccucgcuccugccguggcuccgaauuuccccggcgagcagcugcuguuuuucagaagccagcuuccuuccucuggcgggcgcagccacggaauccucgacugccuggucccccaagagugggugcagcauuuuuaccaggaauccgccccugcgcagacccaagucgcccuugugcgguauguuaaccccgauaccggcagagugcuguucgaggcuaagcuccacaaacugggguuuaugacaaucgccaagaacggagacagcccuauuaccgugcccccgaauggcuacuuccgcuucgaaucuugggucaacccuuuuuauacacuggcucccauggggacgggcaauaaacggagacgcauccaguga

SEQ ID NO: 26966 - RNA, 1623 nt, Artificial Sequence
  derived and/or modified sequence opt5 from VP1__Norovirus__AEG79290
augaagauggccagcaacgacgcuaaucccuccgauggcucugccgcgaaccuggugccugaggucaauaacgaaguuauggcucucgagccgguggccggggccgcucuggccgcucccguggccggacagcaaaaugucaucgacccuuggauuagaaacaauuucgugcaggcgcccggcggggaauuuaccguuagcccucggaacgcccccggagagauccuuugguccgcuccucugucuccggaucucaaucccuaccugagccaccuugcccgcauguauaacuccuacgcuggcggguucgaagugcaggucauucuggccggaaaugcguuuacagccggcaaaaucauuuucgcugccgugccucccaacuuuccuaucgagggccucucucccagccagguuacgauguucccgcauaucauuguggacgucagacaacuggagccugugcugaucccccucccugaugugcggaauaacuuuuaucacuacaaucaguccaacgaacccaccauuaagcugaucgcuaugcuuuauacaccccugcgcgccaacaaugccggggaggacgucuucaccguuagcugcagagugcucacacggccuucuccggauuuugacuucauuuuucuggugcccccuaccgucgaaucccgcacaaaacccuucaccgugccuauccuuacgguugaggagaugaccaacagcagauuucccauuccgcuggaaaagcuguucacaggaccuucuuccagcuucgugguccagccccagaauggccgguguaccacagauggggugcugcugggaaccacgcaacucucuccuguuaacaucugcacauuucgcggcgacgugacccauaucgcuggguccagaaauuacacaaugaaccuggcgagcauuaauuggaacaauuaugaucccaccgaggaaaucccugcuccccuuggaaccccggacuucgucggcaaaauucagggcaugcugacacagacgacccgcggggauggauccacacggggccacagagccaccguguacacagggucugccccuuuuacccccaagcucggaagcguccaguucacgacagacaccgacaacgauuuugagaccaaucaaaacacaaaguucacccccgugggcguugugcaggacggggauacagcccaucggaaugaaccucagcaauggguccugccguccuacagcggacgcaacgugcagaauguucaccuugcucccgccguggcgccuacguuucccggcgagcagcuccucuucuuuagaucuaccaugccuggcuguuccggguaucccaacauggaccuggauugccugcucccucaggaguggguccaacacuucuaccaggaagcugcccccgcccagagcgacguggcucugcuucgguuugugaacccggauacaggaagaguucuguucgaguguaaacuccauaagucuggcuaugucaccguggcccacacagggcagcaugaccuggugaucccucccaauggauacuuucgcuucgauagcugggucaaccaauucuauacccuugcuccuaugggcaaugggacgggccggagacgcgcccuguga

SEQ ID NO: 26967 - RNA, 1608 nt, Artificial Sequence
  derived and/or modified sequence opt5 from VP1__Norovirus__AEI29586
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgagaaucacguuuggaacaugcaagugaccaauauugaugggacaccuuucgaccccaccgaagaugucccugcuccccugggaaccccggacuucagcggcaaacucuuuggggugcugucucagcgcgaccaugauaacgccuguagaucccacgacgccgucaucgcuacaaauagcgcgaaguucacgccuaaacuuggagccauucagaucggcaccugggagcaggaugacgugcacaucaaccagcccacaaaguuuacccccguugggcuguucgaguccgaaggauuuaaucaauggacacucccuaacuauucuggcgcucugacccuuaauaugggccuggccccgcccguggccccuacguuccccggggagcagauucucuuuuuccggagccauaucccucugaagggaggcgucgcugaucccgugauugacugccugcucccucaggaauggauccagcaccuguaccaagaguccgcccccagccagacagauguugcgcuuauucgcuuuaccaacccggacaccgggagagugcuguucgaagcuaaacuccaucggucuggauacaucacagucgccaacaccggcuccagaccuaucguggugcccgccaauggguauuuucgcuucgauagcuggguuaaccaguuuuacucucuggcuccuaugggcacaggaaauggccggagacgcguccaguga

SEQ ID NO: 26968 - RNA, 1623 nt, Artificial Sequence
  derived and/or modified sequence opt5 from VP1__Norovirus__AEJ82646
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacguuuuuaccgcugggaaaauuaucuucgccgcggugccucccaauuuuccuacagagggacugagccccucccaggucaccauguucccgcauaucauuguggacgugagacaacucgagccuguccugaucccccugccugauguucggaacaauuuuuaucacuacaaccagucuaaugaccccacaauuaagcucaucgccaugcuguauacaccccuucgcgcuaacaacgccggcgaugacguguucaccgugagcugcagaguccugacccggccuuccccggauuuugacuucauuuuucucgcucccccuacgguggaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccauucaguucucuaccgauacaagcaaugacuuugagaccgggcagaacacaagauucacgcccgugggagucgugcaagauggcuccaccacacaccagaaugaaccccagcaguggguucucccugacuacagcggccgggauucucacaacgugcaucuggcuccggccgucgcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguggcgcuccugagauuuguuaaucccgacaccgggcggguccuuuucgaguguaaacugcauaaguccggauacgugacgguggcucacaccggccagcacgaucucgucaucccgccuaacggguauuuuagauucgacucuugggugaaccaguucuacacacuggcccccaugggcaauggagccggccgccggagagcucuuuga

SEQ ID NO: 26969 - RNA, 1623 nt, Artificial Sequence
  derived and/or modified sequence opt5 from VP1__Norovirus__AER11308
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccuaacuacagcggccgggacucucacaauguccaucuggcuccggccguggcccccaccuuuccuggggagcaacuucuguucuuucgcuccacaaugcccggauguagcggcuacccuaacaugaaucucgauugccugcugccccaggaaugggugcagcacuucuaucaggagucugcuccugcccaaagcgacguugcgcuccugagauuugucaaccccgauaccgggcgggugcuuuucgaguguaaacugcauaaguccggauacgugacggucgcucacaccggccagcacgaccucgugauuccgccuaacggguauuuuagauucgauucuuggguuaaucaguucuacacacuggcccccaugggcaacggagccggccgccggagagcucuuuga

SEQ ID NO: 26970 - RNA, 1623 nt, Artificial Sequence
  derived and/or modified sequence opt5 from VP1__Norovirus__AER11310
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacagugaaucucgcuagccagaacuggaauaacuaugaucccacggaggaaauuccugcgccccugggcaccccggacuucgucgggaaaauccagggagugcuuacacaaaccacaagacgggacggcucuacccgcgggcacaaggccacgguuuccacaggaagcgugcauuuuaccccuaagcugggcuccguccaguucucuaccgauacaagcaaugacuuugagaccgggcagaacacaagauucacgcccgugggaguugugcaagauggcuccaccacacaccagaaugaaccccagcaguggguccucccuaacuacagcggccgggacucucacaaugugcaucuggcuccggccguggcccccaccuuuccuggggagcaacuucuguucuuucgcuccacaaugcccggauguagcggcuacccuaacaugaaucucgauugccugcugccccaggaauggguucagcacuucuaucaggagucugcuccugcccaaagcgacgucgcgcuccugagauuugugaaccccgauaccgggcgggugcuuuucgaguguaaacugcauaaguccggauacgucacgguggcucacaccggccagcacgaccucguuauuccgccuaacggguauuuuagauucgauucuugggugaaucaguucuacacacuggcccccaugggcaacggagccggccgccggagagcucuuuga

SEQ ID NO: 26971 - RNA, 1623 nt, Artificial Sequence
  derived and/or modified sequence opt5 from VP1__Norovirus__AER11312
augaagaucgccagcuccgacgcuaaccccucugauggcagcaccgccaaucuggugccugaggucaacaaugaaguuauggcgcucgagccgguggugggggcugccauugccgcucccgucgccggacagcaaaacgugaucgacccuuggauuagaaauaacuucguucaggcucccggcggggaauuuacaguguccccucggaaugcccccggagagauccuguggucugcgccucuuggcccggaucugaaccccuaccucagccaccuggcccgcauguauaauuccuacgcugggggauucgaaguccaggugauucuugccggcaacgcuuuuacggccggcaaaaucaucuucgcggccguuccucccaauuuuccuaccgaggggcugucucccagccaggugacaauguucccgcauauuaucgucgacgugagacaacucgagccugugcugauuccccugccugauguccggaacaauuuuuaucacuacaaccaguccaaugaccccaccaucaagcucauugcuaugcuguauacaccccuucgcgccaacaacgcuggagaugacguuuucaccgugagcugcagagugcugacacggccuucuccggauuuugacuucaucuuucucgugcccccuaccgucgaaucccgcacgaaacccuucagcguuccuauucugaccguggaggaaaugacaaauucuagauuucccaucccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauauugccuccacccaggaguacaccaugaaccucgcuagccagaauuggaacaauuaugaucccacagaagagaucccugcgccccugggaacgccggacuucgugggcaaaauucagggcguccuuacccaaacaaccagacgggacggguccacacgcggacacaaggccaccgugucuacgggcagcguucauuuuacaccuaagcuggggagaauccaguucuccaccgauaccagcaacgacuuugaaacaggacagaauacccgguucacacccgugggcgucgugcaagaugggucuacgacccaccagaacgagccccagcaguggguucucccuaauuacuccggacgcgacagccacaacgugcaucuggcuccggccgucgcccccucuuuuccuggcgaacaacuucuguucuuuagaagcacaaugcccggcuguuccggguacccuaauaugaaccucgauugccugcugccccaggagugggugcagcacuucuaucaggaggcugccccugcgcaaucugacguggcucuccugcgguuuguuaaucccgauaccggaagaguccuuuucgaauguaaacugcauaagagcggcuacgugacaguggcccacaccgggcagcacgaccucgucauuccgccuaacggauauuuucgcuucgauuccugggugaaccaguucuacacgcuggcccccaugggcaaugggaccggccggagacgcgcucuuuga

SEQ ID NO: 26972 - RNA, 1623 nt, Artificial Sequence
  derived and/or modified sequence opt5 from VP1__Norovirus__AER11314
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcaccagaaauuacaccaugaaccucgcgucccugaauuggaacaauuaugacccuacagaagagauucccgccccucuugggacgcccgauuucgugggaaaaauccagggcguccugacccagacaaccaagggggacggaagcacacggggccacaaggcuaccguguacacggggucugccccguuuacaccuaaacucggauccguucaguucagcaccgacaccgaaaacgauuuugagacacaucaaaauaccaaguucacacccgugggcgucauucaggacggcgggacgacccaccgcaacgaaccccagcaaugggugcugccuuccuacucuggaagaaauguucacaacgugcaucuugccccggcugucgcccccacauuuccuggcgagcagcuccuguucuuucggagcaccaugcccggguguuccggauauccuaauauggaucuggacugccugcucccccaggagugggugcagcacuucuaccaagaagcggcuccugcccagagcgauguggcccugaugcgcuuuguuaaccccgacacaggcagaguccuuuucgaguguaaacugcauaagucuggguaugugaccguggcucacacgggccagcacgaucucgucaucccgccuaacggauacuuucgguucgacuccugggugaaucaguucuauacccuggcccccaugggcaacgggacaggaagacgccgggcucuuuga

SEQ ID NO: 26973 - RNA, 1623 nt, Artificial Sequence; identical to SEQ ID NO: 26932
  derived and/or modified sequence opt5 from VP1__Norovirus__AER11316

SEQ ID NO: 26974 - RNA, 1623 nt, Artificial Sequence; identical to SEQ ID NO: 26932
  derived and/or modified sequence opt5 from VP1__Norovirus__AER11318

SEQ ID NO: 26975 - RNA, 1623 nt, Artificial Sequence
  derived and/or modified sequence opt5 from VP1__Norovirus__AER11320
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucgucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaagauguguucaccguguccugcagaguccugacccggcccagcccugacuuugauuucaucuuucucgugccgcccacaguugagucucgcaccaaaccuuucacggugcccauucugaccgucgaagagaugacaaacuccagauuuccuaucccccuugagaagcuguucaccgggccgagcggagccuucgugguucagccucagaauggccgguguacaaccgacggggugcuccugggaacgacacaacugucucccgucaacauuugcaccuuucgcggcgaugugacacauaucgcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacaguuuacaccggguccgccccguuuacgccuaaacucggaagcgugcaguucuccacagacaccgaaaacgauuuugagacccaucaaaauacaaaguucacccccgucggcgugauccaggacggcucuacaacgcaccgcaacgaaccccagcaauggguucugccuagcuacuccgggagaaaugugcacaacguccaucuugccccggcuguggcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguugcccugcuucgcuuugucaaccccgacaccggaagagugcuguucgaguguaaacuccauaagagcggcuaugugacagucgcucacaccgggcagcacgaucuggugauuccgccuaacggcuacuuucgguucgacucuuggguuaaucaguucuauacgcuugcccccaugggaaacggcaccgggagacgccgggcucuguga

SEQ ID NO: 26976 - RNA, 1623 nt, Artificial Sequence; identical to SEQ ID NO: 26932
  derived and/or modified sequence opt5 from VP1__Norovirus__AER11324

SEQ ID NO: 26977 - RNA, 1623 nt, Artificial Sequence
  derived and/or modified sequence opt5 from VP1__Norovirus__AER11326
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuaccucgucccgcccacaguggagucucgcaccaaaccuuuuacgguucccauccugaccguggaagagaugacaaacuccagauucccuauuccccuugagaagcuguuuaccgggccgagcggagccuucgucgugcagccucagaauggccgguguacaaccgacgggguucuccugggaacgacacaacugucucccgugaacaucugcaccuuccgcggcgaugucacacauaucgcuggcuccagaaauuauaccaugaaccucgcgagccugaauuggaacaauuacgacccuaccgaagagauucccgccccucuugggacacccgauuuugugggaaaaauccagggcguccugacgcagaccacaaagggggacggaucuacccggggccacaaggcuacaguguacaccgggggagccccguucacgccuaaacucggcuccguucaguuuagcacagacaccgaaaacgauuucgagacccaucaaaauacaaaguuuacccccgugggcgucauucaggacggguccacaacgcaccgcaacgaaccccagcaaugggugcugccuucuuauagcggaagaaauguucacaacgugcaucuugccccggcugucgcccccaccuucccuggcgagcagcugcucuuuuuccgguccacaaugcccggguguagcggauacccuaauauggaucuggacugccugcucccccaggagugggugcagcacuuuuaucaagaagcggcuccugcccagucugauguggcccugcuucgcuucguuaaccccgacaccggcagaguccuguuugaguguaaacuccauaaguccggguacgugacaguggcucacaccggccagcacgaucuggucaucccgccuaacggauauuuccgguuugacagcugggugaaucaguucuacacgcuugcccccaugggcaacgggaccggaagacgccgggcucuguga

SEQ ID NO: 26978 - RNA, 1623 nt, Artificial Sequence; identical to SEQ ID NO: 26945
  derived and/or modified sequence opt5 from VP1__Norovirus__AER11328

SEQ ID NO: 26979 - RNA, 1623 nt, Artificial Sequence
  derived and/or modified sequence opt5 from VP1__Norovirus__AER11330
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagacacccgccccucuugggacgcccgauuucgugggaaaaauucagggcguccugacccagacaaccaagggggacggaucuacacggggccacaaggcuaccguguacacgggguccgccccguuuacaccuaaacucggaagcguucaguucuccaccgacaccgaaaacgauuuugagacacaucaaaauaccaaguucacacccgugggcgucauccaggacggcucuacgacccaccgcaacgaaccccagcaaugggugcugccuagcuacuccgggagaaauguucacaacgugcaucuugccccggcugucgcccccacauuuccuggagagcagcuccuguucuuucggagcaccaugcccggcuguucuggguauccuaauauggaucuggacugccugcucccccaggagugggugcagcacuucuaccaagaagcggcuccugcccaguccgauguggcccugcuucgcuuuguuaaccccgacacaggaagaguccuguucgaguguaaacuccauaagagcggcuaugugaccguggcucacacggggcagcacgaucuggucauuccgccuaacggcuacuuucgguucgacucuugggugaaucaguucuauacccuugcccccaugggaaacggcacagggagacgccgggcucuguga

SEQ ID NO: 26980 - RNA, 1623 nt, Artificial Sequence; identical to SEQ ID NO: 26480
  derived and/or modified sequence opt5 from VP1__Norovirus__AER11332

SEQ ID NO: 26981 - RNA, 1623 nt, Artificial Sequence; identical to SEQ ID NO: 26945
  derived and/or modified sequence opt5 from VP1__Norovirus__AER11334

SEQ ID NO: 26982 - RNA, 1623 nt, Artificial Sequence
  derived and/or modified sequence opt5 from VP1__Norovirus__AER11336
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucaauacagauaccgaaaacgacuuugagacccaucaaaauacaaaguucaccccugugggagucauucaggauggcuccacaacgcaccgcaacgaaccccagcaaugggugcugcccucuuacagcggcagaaauguucacaacgugcaucuugccccugcggucgcuccgaccuuucccggggagcagcuccuguucuuucgguccacaaugccuggauguagcggcuaucccaauauggaccuggauugccugcucccucaggagugggugcagcacuucuaccaagaagccgcccccgcucagucugacguggcccugcuucgcuuuguuaacccugauaccgggagaguccuguucgaguguaaacuccauaaguccggauaugugacaguggcucacaccggccagcacgaccuggucauucccccgaacggguacuuucgguucgauagcugggugaaucaguucuauacgcuugccccuaugggcaacggaaccggcagacgccgggcgcuguga

SEQ ID NO: 26983 - RNA, 1623 nt, Artificial Sequence
  derived and/or modified sequence opt5 from VP1__Norovirus__AER11340
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcucuacaacgcaccgcaaugaaccccagcaaugggugcugcccagcuacuccggcagaaacguucacaaugugcaucuugccccugcggucgcuccgaccuuucccggggagcagcuccuguucuuucggagcacaaugccuggauguucuggcuaucccaacauggaccuggauugccugcucccucaggagugggugcagcacuucuaccaagaagccgcccccgcucaguccgacguggcccugcuucgcuuuguuaauccugauaccgggagaguccuguucgaguguaaacuccauaagagcggauaugugacaguggcucacaccggccagcacgaccuggucauucccccgaacggguacuuucgguucgauucuugggugaaccaguucuauacgcuugccccuaugggcaauggaaccggcagacgccgggcgcuguga

SEQ ID NO: 26984 - RNA, 1623 nt, Artificial Sequence; identical to SEQ ID NO: 26983
  derived and/or modified sequence opt5 from VP1__Norovirus__AER11342

SEQ ID NO: 26985 - RNA, 1623 nt, Artificial Sequence
  derived and/or modified sequence opt5 from VP1__Norovirus__AER11344
augaagauggccagcaacgacgcuucccccucugauggcagcgccgcgaaucuggugccugaggucaacaaugaaguuauggcucucgagccgguggugggggccgccaucgcugcccccgucgcuggacagaaaaacgugaucgacccuuggaucagaaauaacuucguucaagcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaagauuaucuucgccgcuguuccucccaauuuuccuacggagggacugucccccucucaggugaccauguucccgcauaucauugucgacgugagacagcucgagccugugcugaucccccugccugauguccggaacaauuuuuaucacuacaaccaaagcaaugacuccacaauuaaacucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaagccuuucacgguucccauccugaccguggaagagaugacaaauagcagauuuccuauuccccuugagaaacuguucaccgggccgucuggagccuucgucgugcagccucagaacggccgguguacaaccgacgggguucuccugggaacgacacagcugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaagauccaaggcguccugacgcagaccacaaaggccgacgggucuacccggggacacaaagccacaguguacaccggcuccgcugacuuuacgccgaagcucgggagcguucaguucuccacagauaccgaaaaugacuuugagacccaucagaacacaaaauucaccccugugggagucauucaagauggcucuacaacgcaccgcaaugaaccccagcagugggugcugcccagcuacuccggcagaaacguucacaaugugcaucuugccccugcggucgcuccgaccuuucccggggagcaacuccuguucuuucggagcacaaugccuggauguucuggcuaucccaacauggaccuggauugccugcucccucaggagugggugcagcacuucuaccaggaagccgcccccgcucaauccgacguggcccugcuucgcuuuguuaauccugauaccgggagaguccuguucgaguguaagcuccauaaaagcggauaugugacaguggcucacaccggccagcacgaccuggucauucccccgaacggguacuuucgguucgauucuugggugaaccaguucuauacgcuugccccuaugggcaauggaaccggcagacgccgggcgcuguga

SEQ ID NO: 26986 - RNA, 1623 nt, Artificial Sequence; identical to SEQ ID NO: 26983
  derived and/or modified sequence opt5 from VP1__Norovirus__AER11346

SEQ ID NO: 26987 - RNA, 1623 nt, Artificial Sequence
  derived and/or modified sequence opt5 from VP1__Norovirus__AER11348
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacuguccucuagccaggugaccauguucccccauaucauugucgacgugagacaacucgagccggugcugaucccucugcccgauguccggaacaauuuuuaucacuacaaccaguccagcgacucuacaauuaagcucaucgccaugcuguauaccccucuucgcgcuaauaacgccggcgaagauguuuucacaguguccugcagagugcugacccggcccagccccgacuuugauuucauuuuucucgucccuccgacaguggagucucgcaccaaacccuucacgguuccuauccugaccguggaagagaugacaaacuccagauuucccauuccucuugagaagcuguucaccgggcccagcggagccuucgucgugcagccgcagaauggccgguguacaaccgacgggguucuccugggaacgacacaacugucuccugugaacaucugcaccuuucgcggcgaugucacacauaucgcuggcuccagaaauuacaccaugaaccucgcggcccugaauuggaacaauuaugaccccaccgaagagauuccugcuccccuugggacaccugauuucgugggaaaaauccagggcguccugacgcagaccacaaaggccgacgggagcacccggggacacaaggccacaguguacaccggcuccgcugacuuuacgcccaaacucgggucuguucaguucagcacagauaccgaaaacgacuuugagacccaucaaaauacaaaguucaccccggugggagucauucaggauggcuccacaacgcaccgcaacgaaccucagcaaugggugcugcccagcuacucuggcagaaauguucacaacgugcaucuugcccccgcggucgcuccuaccuuuccgggggagcagcuccuguucuuucgguccacaaugcccggauguagcggcuauccuaauauggaccuggauugccugcucccccaggagugggugcagcacuucuaccaagaagccgccccugcucagucugacguggcccugcuucgcuuuguuaaccccgauaccgggagaguccuguucgaguguaaacuccauaagagcggauaugugacaguggcucacaccggccagcacgaccuggucaucccucccaauggguacuuucgguucgauuccugggugaaccaguucuauacgcuugccccgaugggcaacggaaccggcagacgccgggcgcuguga

SEQ ID NO: 26988 - RNA, 1623 nt, Artificial Sequence
  derived and/or modified sequence opt5 from VP1__Norovirus__AER11350
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaacucuagauuucccauuccgcuugagaagcuguucaccgggccuuccagcgccuucgucgugcagccccagaauggacgguguacaaccgauggcguuuuucucgggacgacacaacugucuccugugaacaucugcaccuuccgcggagacgucacacauaucaccggcuccagaaauuacaccaugaaccuggccacacagaauuggaacagcuaugaucccacggaggaaauuccugcuccccucggcaccccggacuuuguggggaaaauccagggaguccugacacagaccacacgggcggacggcuccacccgcgggcacaaggccacgguguacacaggaucugcugauuucgccccuaaacuuggcagaguucaauuugccaccgacaccgauaaugacuucgaugcuaaccagaauacaaaguuuacccccgugggggucauucaggacggagauacagcccaucggaacgagccccaacagugggugcugccuagcuacuccggccgcaauagccacaacguucaccucgcgccggcuguggcccccacguucccuggcgaacagcugcuguuuuucagaucuaccaugcccggguguuccggauauccuaauauggaccuugauugccuccugccccaggaguggguccaauacuuuuaucaggaagccgcuccugcccagagcgacguggcucugcuccgguucgugaaccccgauacaggcagaguucuguuugaguguaaacuucauaagucuggguacgucaccguggcccacacaggacagcaugaccuggugaucccgccuaauggcuauuuccgcuucgacagcugggucaaccaauuuuacacccucgcgcccauggggaacggcacgggacggagacgcgcccuguga

SEQ ID NO: 26989 - RNA, 1623 nt, Artificial Sequence
  derived and/or modified sequence opt5 from VP1__Norovirus__AER11352
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggaggcacagcccaucggaaugagccccaacagugggugcucccuucuuacagcggccgcaacucccacaauguucaccuggcgccggcuguggcccccacguuuccuggggaacagcuucuguucuuuagaagcaccaugcccggauguucuggcuauccuaacauggaucucgacugccugcugccccaggaguggguccaauacuucuaucaggaagccgcuccugcccaguccgauguggcucuccugcgguuugugaaucccgacacagggagaguucuuuucgaguguaagcugcauaaaagcggauacgucaccguggcccacacaggccagcaugaucucgugaucccgccuaacggguauuuucgcuucgacucuugggucaaccaauucuacacccuggcgcccaugggcaauggaacgggccggagacgcgcccuuuga

SEQ ID NO: 26990 - RNA, 1623 nt, Artificial Sequence
  derived and/or modified sequence opt5 from VP1__Norovirus__AER11354
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcucuacaacgcaccgcaacgagccccagcaaugggugcccccuagcuacuccggcagaaauguucacaacgugcaucuggcuccggccgucgcgcccaauuuuccuggggaacagcuucuguucuuucggagcaccaugcccggauguucuggcuauccuaacauggaucucgacugccugcugccccaggagugggugcagcacuucuaccaagaggcugccccugcccaguccgauguggcucuccugcgcuuuguuaaccccgacacagggagaguccuuuucgaauguaaacugcauaagagcggauaugugaccguggcccacacaggccagcacgaucucgucaucccgccuaauggguacuuucgguucgacucuugggugaaccaguucuauacccuggcucccaugggcaauggaacgggcagacgccgggcccuuuga

SEQ ID NO: 26991 - RNA, 1623 nt, Artificial Sequence
  derived and/or modified sequence opt5 from VP1__Norovirus__AER11356
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcucuacaacgcaccgcaacgagccccagcaaugggugcugcccagcuacuccggcagaaauguucacaacgugcaucuugcuccugccgucgcgccgaauuuucccggggaacagcuccuguucuuucggagcaccaugccuggauguucuggcuaucccaacauggaucuggacugccugcucccucaggagugggugcagcacuucuaccaagaggcugcccccgcccaguccgauguggcucugcuucgcuuuguuaacccugacacagggagaguccuguucgaauguaaacuccauaagagcggauaugugaccguggcccacacaggccagcacgaucuggucauucccccgaauggguacuuucgguucgacucuugggugaaccaguucuauacccuugcuccuaugggcaauggaacgggcagacgccgggcccuguga

SEQ ID NO: 26992 - RNA, 1623 nt, Artificial Sequence; identical to SEQ ID NO: 26482
  derived and/or modified sequence opt5 from VP1__Norovirus__AER11358

SEQ ID NO: 26993 - RNA, 1623 nt, Artificial Sequence
  derived and/or modified sequence opt5 from VP1__Norovirus__AER11360
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcaucucaucgucgacgugagacaacuggagccugugcugauuccccucccugauguccggaacaauuuuuaucacuacaaccagagcaaugacuccaccaucaagcugauugcuaugcuuuauacaccccugcgcgccaacaacgcuggcgaugacguuuucaccgugagcugcagagugcucacacggcccucuccugauuuugacuucaucuuucuggucccgcccaccguggaaucccgcacgaaaccuuucagcguucccgugcuuaccgucgaggaaaugacaaauucuagauuuccuauuccccuggagaagcuguucaccgggccguccagcgccuucgugguucagccucagaacggacgguguacaaccgauggcgugcugcuggggacgacacaacucucucccgucaauaucugcaccuuucgcggagacgugacacauauuccuggcuccagaaacuacaccaugaaucuggccagccagaacuggaacuccuaugaucccaccgaggaaaucccugcuccccuuggcacaccggacuucgucgggaaaauccagggagugcugacgcagaccacacggaccaauggcucuacacgcgggcacaaggcgaccguuuacacgggaagcgccgacuuuuccccuaagcucggcagagugcaauucgcuacagauaccgacaaugauuuugagaccaaccagaauacaaaauucacccccgucggggugauucaggacggaagcacaacgccccggaacgaaccucaacaguggguucugccgucuuacuccggccgcaauauccauaacgugcaccuugcccccgccgucgcuccuaccuuucccggcgagcagcuccucuucuuuagaagcacaaugccuggguguucuggauaucccaauauggaucuggacugccugcucccucaggaaugggugcaauacuucuaucaggaggccgcgcccgcucagagcgauguggcccugcuucgguuuguuaacccggacaccggcagaguccuguucgaguguaagcuccacaaauccggguacgugacaguggcccauaccggacagcacgaucuggucauuccucccaacggcuauuuucgcuucgacucuugggugaaucaauucuacacgcuugcuccuauggggaacggcaccggacggagacgcgcccuguga

SEQ ID NO: 26994 - RNA, 1647 nt, Artificial Sequence
  derived and/or modified sequence opt5 from VP1__Norovirus__AEX10549
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaccgauaaucuguccgcugcccagaucacaaugugcccucaugucaucguggacguucgccaacuggaacccauuaaccucccgaugccugaugugagaaauaacuucuuucacuauaaccagggcucugacagccggcugcgccuugucgccaugcuguacacaccccucagagcuaauaacuccggggaugacguguucaccgugucuugucggguccugacccgcccuagccccgauuuuuccuucaauuuucuuguucccccuacaguggagagcaagaccaaaccguucacgcugcccauccucaccauuucugaaauguccaacagcagauuuccugugcccaucgacucucugcauacauccccuaccgauaauauugucgugcagugccagaacggacggguuacacuggacggcgagcucauggggaccacgcaacugcuucccagccagaucugugcguuccgcggagugcugacaagaucuaccucccgggccagcgaucaggcugacacagccaccccgcgccucuucaauuaucacuggcauauccagcuggacaaccuuaauggcaccccuuacgaucccgccgaggacauuccugcuccccugggcacaccugauuuuagagggaaggucuucggaguggccucccaacggaaccccgacucuacgacccgcgcgcacgaagcuaaaguugauacaaccagcggcagauuuacaccgaagcucgggucccuggagaucagcaccgaaucuggagacuucgaucagaaucagccuacgcgguuuacacccgugggcauuggggucgacaacgaggccgauuuccaacaguggacccugcccgacuauuccggacaguuuacccacaauaugaaccucgccccugcuguggccccgaauuuccccggcgaacagcugcuguuuuucagaagccaucuuccuucuagcggcgggcgcuccaacggaauccucgauugccuggucccccaagagugggugcagcacuuuuaccaggagucugcuccugcccagacacaaguugcgcuugugcgguacgucaaccccgacaccggcagagugcuguucgaagccaagcuccauaaacugggguuuaugacaauugcuaagagcggagacuccccuaucacgguucccccgaauggcuauuuccgcuucgagagcugggugaacccuuuuuacacccuggcccccauggggacaggcaauggacggagacgcauccaguga

SEQ ID NO: 26995 - RNA, 1623 nt, Artificial Sequence
  derived and/or modified sequence opt5 from VP1__Norovirus__AEX91910
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaacacccgcuccgcugggcacgccugacuucgucgggaaaauccagggagugcuuacccagacaacccggacaaacggcuccacccgcgggcacaaggcgacgguuuacacaggaucugccgacuuuagccccaagcugggcagagugcaauucgcuaccgauaccgacaaugauuuugagacaaaccagaauaccaaauucacacccgucggggugauucaggacggauccacgaccccucggaacgaaccgcaacaguggguucuccccagcuacucuggccgcaauauccauaacgugcaccuggccccugccgucgcucccacauuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacgggacagcacgaucucgucauucccccuaacggcuauuuucgcuucgacuccugggugaaucaauucuacacccuggcucccauggggaacggcacaggacggagacgcgcccuuuga

SEQ ID NO: 26996 - RNA, 1737 nt, Artificial Sequence
  derived and/or modified sequence opt5 from VP1__Norovirus__AFD30970
augaagauggccagcuccgacgcuacccccucuagcgauggcgccgggaaccuggugccugagucccagcaagaaguccucccgcuggcgcccguugcuggagccgcccuugcugccccuguggugggccagcagaauaucauugaccccuggaucaaagagaacuucguccaggcuccucaaggggaauuuacagugucucccaagaauagcccuggagagguucuggugaaccucgaacuguccccgagacuuaaucccuaccuggaucaccucucuaaaauguauaacgccuacgcgggcgggauggaggucgagauuauccuggccggaaaugcuuucacggccggcaaggugcugauugcugccguuccucccaacuuuccuaucgaaaauaucagcgcgucccaggccagccaguucccccaugugauugucgacgugcggacccucgagccgauccgccugccucuucccgaugugagaacaaacuuuuuccacuauaccacacaggaggaaccucggaugcgcauugucgcuuggcuguacacaccccucagaaccaauggcucuggggacgauuccuuuaccguuagcggacggauccugacgcgccccucuccugacuucgaguuuuccuuccuugugccgcccaccguggaaacaaaaaccgucagcuuuucugugccuggccugguuguggaggauauguccaacagcagauggcccgcccaaauuaaugggcucgucgugcggggaaacgaagcucagguugugcauuuccagaauggccgcugcacaaccgaggggacgcugcugggaacaaccacacucuccaucaacucuauuuguggccugagaggccuuagcgucucccaggccagcgugcgcggggccccugcucugaccgaagagaugcccccgcucgaggacgaagucgcggauggagccgcugccaccuauacacuggcccgggcugccgacacgacccuuuggcugagaguggaggaaccugauggccggcccuacgacaucuuuggggaccaaccugcgccccucggaacaccugauuucaccgcuguuaucgugggcacagccauucgccccagaaccgccucuggggcuuaucugcacgacgccuacgucgauacgacaccgggagacgcugauuucaccccuuccaccggcaacacaaagaucgugcugcggggcgggggaagcggccauguugggcagggacacuacuggcaguuuagacccauugccguggagggcgggggcucucgcccccaauaucaggaauacaaucucccugacuaugcgggaccgaccgccagcaaccacgaucuggcucccccugucgcuccccggaugccuggcgagcuucugcuccuguucgaguccgacaugcccgugugggauaauggggccggagccgcgccugcccagaagauccauugccuucugcccaacgaauuuauuacacaccucuucgaccugcaggcuccggcccuggcugaggccgcccuccugagauacgugcauccugauucuggccgcacgcuuuuugaauguaaacuguaucgggagggguacaugguugucgcugcgcccgccggaagacucaauuucccucuggacggcuauuuucgcuucgacagcuggguguccgcuuuuuacauccugagccccguggggucuggccaaggacggagaggccgcuccaaggccgccuga

SEQ ID NO: 26997 - RNA, 1623 nt, Artificial Sequence
  derived and/or modified sequence opt5 from VP1__Norovirus__AFH88383
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccguucagggcauguuuaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguucaucccucuugaaucucccgcgccugucggauuucccgaccugggcgggugugauuggcacgugaauuucaccuuucaggcccaaaaccaggacccuagccaguccgucaccuucgcuacaaaugaugccagcuuugugcccuaucucggaucuaucuccccgcauaacggcggcgacuuccacgccggggauauuaucggaagccugggcuggauuucugcuccuagcgacaauucccagcugaacguuuggacgauccccaaguacgggucuagccuccccgaugugacccaccuggccccugcggucuuuccgcccggauucggcgaggugauucuuuauuuuuacuccacauucccugggagcggccaacccucucagcugcagguuccuugccuccugccccaggaauuuaucacccauuucuguaaugagcaagcuccuaucgccggagaggccgcccuucugcacuauguggaccccgauacaggccggaaccucggggaauuuaagcuguacccggacggauucaugaccugcgucccuaauuccgugagcucuggcccccagacgcugccuauuaacgggguguucguuuuugucuccugggugagccgcuucuaccagcucaaacccgugggaacagcuuccgcugccagacggcugggccuucgcagaaucuga

SEQ ID NO: 26998 - RNA, 1671 nt, Artificial Sequence
  derived and/or modified sequence opt5 from VP1__Norovirus__AFJ21376
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgcugggggaaucgacgugauggucgugcuggccggcaaugcuuucaccgccggcaagguucugauugcugccaucccucccaacuuuccuguggagggggucucugcgagccaagccacacaguucccccaugugaucauugaugugcggacccucgacccgguccgccugccucuucccgauguuagauccacauuuuuccacuauaccaaugacacagagccuaaaaugcggcuggugaucuggcucuacacgccccugcgcaccaacggaagcggcgaugacucuuuuaccguguccgggcggauucuuacaagacccagccaggauuucgaauuugcuuuccugaucccuccgaccgucgagacaaagaccacgcccuuuucugugccuggauucuccguucaggaaaugagcaauucucgcuggcccgccgcuauuuccgccaugguggucagaggcaacgagccucaagugguucaguuucagaaugggcgggcccaucucgacggaaugcugcugggcacaacccccgugagcccgaacuauaucgcuuccuaccgcggcauuucuacagggaauagcagauccgcgagcucugaggccgaugaacgggcugucggauccuucgacguguggguccgccuccaggagccugacggccaacccuaugauaucuucgggaagcagccugcccccaucggaaccccugacuuuaaagccgugauuguuggcuucgcugccagaccccugaccagcgggucuuacgcgaacgaagcguacgugaacacaacggccagcgauuaugccccggcuaccggaaauaugcgguuuacaguccgcaacggcggcaccgggcacaucuccgccaauaaguacugggaguucaaaucuuuuggaguggaaggcgagagacauacagacauucaguaucaagaguacgaacuuccugauuauagcgggcagguugcuuccaaccacaaucuggccccucccguggcgccccggaugccgggagagagccuccugcuuuuccagucuaacaugcccgucugggacgauggccacggggaauccaccccuaagaaaauccauugccugcucccccaggaguuuauuggccacuucuuugacagacaagccccuagccugggagaugcugcccugcuccgcuacgugaaucaggaaacgaaccgggugcuguucgaguguaaacuuuauagagacggcuacaucacaguugcugccucuuccgggcugcucgauuuuccccuggacggauucuuucgcuucgacagcugggucuccucuuucuacauccuuagcccugugggcuccgggcagggacggagaggccgcgugcgguuucaguga

SEQ ID NO: 26999 - RNA, 1608 nt, Artificial Sequence
  derived and/or modified sequence opt5 from VP1__Norovirus__AFJ21379
augaagauggccagcuccgacgcugcccccucuaacgauggcgcggcugggcuggugccugaggucaauaacgaaaccauggcccucgagccgguugccggagcuagcaucgccgcuccccugacaggccagaauaacgugauugacccuuggaucagacuuaauuucgugcaagcccccaacggggaauuuacggucuccccucgcaauucucccggagaggugcugcucaaccuggaacuuggcccugagcugaauccguaccucgcgcaccugagccggauguauaacggguacgccggaggcguugaggugcagguccugcucgcuggcaaugccuucaccgcugggaaacugguguuugccgcgguucccccucauuucccccuugaaaacauuuccccuggacagaucacaauguuuccccacgugauuaucgaugucagaacccuggagccggugcuccugccucuucccgacgugcggaauaacuucuuucauuauaaucagcaaaacgaaccucgcaugagacuggucgccaugcucuacacaccccugcggucuaacggcagcggggaugacguuuucaccguguccugccgcgugcugacaagacccagcccugauuuugacuucaauuaucucgucccgcccaccguggagucuaagacgaaaccuuuuacccugcccauccuuacaaugggagagcugaccaacucccgguucccuguucccauugaugaacucuacacaagcccgaaugagucucuggugguccagccucagaacggccgcugugcucuugacggggaacugcagggaaccacgcaacuccugcccacagccaucugcuccuuuagaggccggauuaaucagaaggugagcggcgauaaccacguuuggaauaugcaagugaccaacaucaaugggacaccuuucgaccccaccgaggaugucccugcuccccugggaaccccggacuucucuggcaaacucuuuggggugcugucccagcgcgaccaugauaacgccuguagaagccacgacgccgucauugcuacaaauuccgcgaaguucacgccuaaacuuggagccauccagauuggcaccugggaacaggaugacgugcacaucaaccagcccacaaaguuuacccccguugggcuguucgagucugagggauuuaaucaauggacacucccuaacuauagcggcgcucugacccuuaauaugggccuggccccgcccguggccccuacguuccccggggaacagauccucuuuuuccggucccauauuccucugaagggaggcgucgcugaucccgugaucgacugccugcucccucaggaguggauucagcaccuguaccaagaaagcgcccccucucagacagauguugcgcuuauccgcuuuaccaacccggacaccgggagagugcuguucgaggcuaaacuccaucgguccggauacauuacagucgccaacaccggcagcagaccuaucguggugcccgccaauggguauuuucgcuucgauucuuggguuaaccaguuuuacagccuggcuccuaugggcacaggaaauggccggagacgcguccaguga

SEQ ID NO: 27000 - RNA, 1608 nt, Artificial Sequence; identical to SEQ ID NO: 26688
  derived and/or modified sequence opt5 from VP1__Norovirus__AFJ21382

SEQ ID NO: 27001 - RNA, 1623 nt, Artificial Sequence
  derived and/or modified sequence opt5 from VP1__Norovirus__AFJ21387
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaauuuacaccggguccgccccguuuacgccuaaacucggaagcgugcaguucuccacagacaccgaaaacgauuuugagacccaucaaaauacaaaguucacccccguuggcgugauccaggacggcucuacaacgcaccgcaacgaaccccagcaauggguccugccuagcuacuccgggagaaaugugcacaacguucaucuugccccggcuguggcccccaccuuuccuggagagcagcuccuguucuuucggagcacaaugcccggcuguucuggguauccuaauauggaucuggacugccugcucccccaggaguggguccagcacuucuaccaagaagcggcuccugcccaguccgauguggcccugcuucgcuuugugaaccccgacaccggaagaguucuguucgaguguaaacuccauaagagcggcuaugucacaguggcucacaccgggcagcacgaucuggugauuccgccuaacggcuacuuucgguucgacucuugggucaaucaguucuauacgcuugcccccaugggaaacggcaccgggagacgccgggcucuguga

SEQ ID NO: 27002 - RNA, 1623 nt, Artificial Sequence; identical to SEQ ID NO: 26922
  derived and/or modified sequence opt5 from VP1__Norovirus__AFJ21388

SEQ ID NO: 27003 - RNA, 1623 nt, Artificial Sequence; identical to SEQ ID NO: 26932
  derived and/or modified sequence opt5 from VP1__Norovirus__AFJ21389

SEQ ID NO: 27004 - RNA, 1623 nt, Artificial Sequence
  derived and/or modified sequence opt5 from VP1__Norovirus__AFJ21390
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacgcgaugaaccucgccucucugaauuggaacaauuaugacccuaccgaagagauucccgcuccucuuggcacccccgauuucguggggaaaauccagggacugcucacacagacgaccaagggcgacggguccacacggggacacaaggccaccgucuacacaggcagcgccccguuuaccccuaaacugggguccgugcaguucucuacggacacagaaaacgauuuugagacccaucaaaauaccaaguucacacccguuggagugauucaggacggcagcaccacacaccgcaacgaaccccagcaauggguccuuccuuccuacagcggcagaaaugugcacaacguucaucuggcuccggccguggcgcccacguuuccuggggagcagcuccuguucuuucggucuaccaugcccggauguuccggcuauccuaauauggaucuggacugccuccugccccaggaguggguccagcacuucuaccaagaagcugccccugcccagagcgauguggcccuucugcgcuuugugaaccccgacacagggagaguucucuucgaguguaaacugcauaagucuggauaugucaccguggcucacacaggccagcacgaucuugugaucccgccuaacggguacuuucgguucgacagcugggucaaucaguucuauacccuggcucccaugggcaacggaacgggcagacgccgggcccucuga

SEQ ID NO: 27005 - RNA, 1623 nt, Artificial Sequence
  derived and/or modified sequence opt5 from VP1__Norovirus__AFJ21391
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccagcgaccccaccauuaagcucaucgcuaugcuguauacaccccuucgcgccaauaacgcuggagaugacguuuucaccgugucuugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccggcccuagcucugccuucgucgugcagccccagaaugggcgguguacaaccgauggaguucuccugggcacgacacaacuguccccugugaacaucugcaccuuucgcggggacgucacacauaucgccggaacccaggaguacaccaugaaucucgcuagccagaacuggaauaacuaugaucccacagaagagauuccugcgccccugggcacgccggacuucgugggcaaaauccaggggguccuuacccaaacaaccagacgggacggauccacacgcggccacaaggccaccgugucuacggggagcguucauuuuacaccuaagcugggacggauucaguucuccaccgauaccagcaaugacuuugaaacaggccagaacaccagauucacacccgugggggucgugcaagauggaucuacgacccaccagaaugagccccagcaguggguucucccuaacuacuccggccgcgacagccacaaugugcaucuggcuccggccgucgcccccucuuuuccuggcgaacaacuucuguucuuuagaagcacaaugcccggguguuccggauacccuaacauggaucucgacugccugcugccccaggagugggugcagcacuucuaucaggaggcugccccugcgcaaucugauguggcucuccugcgguuuguuaaucccgacaccggcagaguccuuuucgaauguaaacugcauaagagcggguacgugacaguggcccacaccggacagcacgaucucgucaucccgccuaacggcuauuuucgcuucgacuccugggugaaucaguucuacacgcuggcccccauggggaacggcaccggacggagacgcgcucuuuga

SEQ ID NO: 27006 - RNA, 1623 nt, Artificial Sequence
  derived and/or modified sequence opt5 from VP1__Norovirus__AFJ21392
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaagauguuuucaccgugagcugcagagugcugacacggcccucuccugacuuugauuucauuuuucucgucccgcccaccguggagucccgcacgaaaccuuucaccguucccauccugacaguggaagagaugaccaauagcagauuuccuauuccccuugagaagcuguucacagggccgucuggagccuucgucgugcagccucagaacggccgguguaccacggacgggguucuccugggaacaacccaacugucccccgugaauaucugcacauuucgcggcgaugucacccauaucgccggcagcagaaacuacaccaugaaucucgcuucucugaacuggaauaacuaugacccuacagaagagauucccgcgccucuugggacgcccgauuucgugggaaaaauccagggcguccugacccagacaaccaagggggacggauccacacggggccacaaggccaccguguacacggggagcgcuccguuuacaccuaaacucggauccguucaguucucuaccgacaccgaaaaugauuuugagacacaucaaaacaccaaguucacacccgugggcgucauucaggacggcagcacgacccaccgcaaugaaccccagcaaugggugcugccuuccuacagcgggagaaacguucacaaugugcaucuugccccggccgucgcucccacauuuccuggagagcagcuccuguucuuucggucuaccaugcccggcuguuccggguauccuaacauggaucuggacugccugcucccccaggagugggugcagcacuucuaccaagaagccgcgccugcucagagcgauguggcccugcuucgcuuuguuaaucccgacacaggaagaguccuguucgaguguaaacuccauaagucuggcuaugugaccguggcccacacggggcagcacgaucuggucaucccgccuaacggcuacuuucgguucgacgcuugggugaaccaguucuauacccuugcccccaugggaaauggcacagggagaaaacgcgcucuguga

SEQ ID NO: 27007 - RNA, 1623 nt, Artificial Sequence; identical to SEQ ID NO: 26945
  derived and/or modified sequence opt5 from VP1__Norovirus__AFJ21393

SEQ ID NO: 27008 - RNA, 1623 nt, Artificial Sequence; identical to SEQ ID NO: 26932
  derived and/or modified sequence opt5 from VP1__Norovirus__AFJ21394

SEQ ID NO: 27009 - RNA, 1623 nt, Artificial Sequence; identical to SEQ ID NO: 26945
  derived and/or modified sequence opt5 from VP1__Norovirus__AFJ21395

SEQ ID NO: 27010 - RNA, 1623 nt, Artificial Sequence; identical to SEQ ID NO: 26932
  derived and/or modified sequence opt5 from VP1__Norovirus__AFJ21396

SEQ ID NO: 27011 - RNA, 1623 nt, Artificial Sequence
  derived and/or modified sequence opt5 from VP1__Norovirus__AFJ21397
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgauccugugcugaucccccugccugacguccggaacaauuuuuaucacuacaaccaguccaaugaucccaccauuaagcucaucgcuaugcuguauacaccccuucgcgccaacaacgcuggagacgauguuuucaccgugagcugcagagugcugacacggccuucuccggacuuugauuucauuuuucucgugcccccuaccgucgagucccgcacgaaacccuucagcguuccuauccugaccguggaagagaugacaaauucuagauuucccauuccgcuugaaaagcuguucaccggcccuuccagcgccuucgucgugcagccccagaacgggcgguguacaaccgacggaguucuccugggcacgacacaacugucuccugugaauaucugcaccuuucgcggggaugucacacauaucgccggaacccaggaguacaccaugaaccucgcuucccagaauuggaacaauuaugaccccacagaggaaauuccugcgccccugggcacgccggacuucgugggcaaaauccaggggguccuuacccaaacaaccagaggagauggcagcacacgggggcacaaggccaccguguccacgggaucuguucauuuuacaccuaagcugggccgcauucaguucagcaccgacaccuccaacgauuuugagacagggcagaauaccagauucacacccgugggagucgugcaagacggcagcacgacccaccagaacgaaccccagcaguggguucucccuaauuacucuggccgggauucccacaacgugcaucuggcuccggccgucgcccccagcuuuccuggggagcaacuucuguucuuucgcucuacaaugcccggauguagcggcuacccuaauaugaaccucgacugccugcugccccaggaaugggugcagcacuucuaucaggaggcugccccugcgcaauccgauguggcucuccugagauuuguuaaucccgacaccgggcggguccuuuucgaguguaaacugcauaagucuggauacgugacaguggcccacaccggccagcacgaucucgucaucccgccuaacggguauuuuagauucgacagcugggugaaccaguucuacacgcuggcccccaugggcaauggaaccggccgccggagagcucuuuga

SEQ ID NO: 27012 - RNA, 1623 nt, Artificial Sequence
  derived and/or modified sequence opt5 from VP1__Norovirus__AFJ21398
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccuucuaacggcuacuuucgguucgacagcugggugaaucaguucuauacgcuugcccccaugggaaacggcaccgggagacgccgggcucuguga

SEQ ID NO: 27013 - RNA, 1623 nt, Artificial Sequence
  derived and/or modified sequence opt5 from VP1__Norovirus__AFJ21399
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcaauacaacgcaccgcaacgaaccccagcaaugggugcugcccucuuacagcggcagaaauguucacaacgugcaucuugccccugcggucgcuccgaccuuucccggggagcagcuccuguucuuucgguccacaaugccuggauguagcggcuaucccaauauggaccuggauugccugcucccucaggagugggugcagcacuucuaccaagaagccgcccccgcucagucugacguggcccugcuucgcuuuguuaacccugauaccgggagaguccuguucgaguguaaacuccauaaguccggauaugugacaguggcucacaccggccagcacgaccuggucauucccccgaacggguacuuucgguucgauagcugggugaaucaguucuauacgcuugccccuaugggcaacggaaccggcagacgccgggcgcuguga

SEQ ID NO: 27014 - RNA, 1623 nt, Artificial Sequence; identical to SEQ ID NO: 27012
  derived and/or modified sequence opt5 from VP1__Norovirus__AFJ21400

SEQ ID NO: 27015 - RNA, 1623 nt, Artificial Sequence
  derived and/or modified sequence opt5 from VP1__Norovirus__AFJ21401
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagagacuacaccaugaaccucgcgucucugaauuggaacaauuaugauccuaccgaagagacacccgccccucuugggacgcccgacuucgugggaaaaauucagggcaugcugacccagacaaccaagggggacggauccacacggggccacaaggcuaccgucuacacggggagcgccccguuuacaccuaaacucggauccgugcgcuucucuaccgauaccgaaaacgacuuugagacacaucagaauaccaaguucacacccguuggcgugauccaagauggcagcacgacccacagaaacgaaccccagcaguggguccugccuuccuacagcgggcgggacgugcacaauguucaucuugccccggcuguggcccccacauuuccuggagagcaacuccuguucuuucgcucuaccaugcccggcuguuccggguauccuaacauggaucuggacugccugcucccccaggaguggguccagcacuucuaccaggaagcggcuccugcccaaagcgauguggcccugcuuagauuugugaaucccgacacaggacggguucuguucgaguguaaacuccauaagucuggcuaugucaccguggcucacacggggcagcacgaucuggugauuccgccuaacggcuacuuuagauucgacagcugggucaaucaguucuauacccuugcccccaugggaaacggcacagggcgccggagagcucuguga

SEQ ID NO: 27016 - RNA, 1623 nt, Artificial Sequence
  derived and/or modified sequence opt5 from VP1__Norovirus__AFJ21402
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagagacuacaccaugaaccucgcgucucugaauuggaacaauuaugauccuaccgaagagauucccgccccucuugggacacccgacuucgugggaaaaauccagggcaugcugacgcagaccacaaagggggacggauccacccggggccacaaggcuacagucuacaccgggagcgccccguuuacgccuaaacucggauccgugcgcuucucuacagauaccgaaaacgacuuugagacccaucagaauacaaaguucacccccguuggcgugauucaagauggcagcacaacgcacagaaacgaaccccagcaguggguccugccuuccuacagcgggcgggacgugcacaauguucaucuugccccggcuguggcccccaccuuuccuggagagcaacuccuguucuuucgcucuacaaugcccggcuguuccggguauccuaacauggaucuggacugccugcucccccaggaguggguccagcacuucuaccaggaagcggcuccugcccaaagcgauguggcccugcuuagauuugugaaucccgacaccggacggguucuguucgaguguaaacuccauaagucuggcuaugucacaguggcucacaccgggcagcacgaucuggugaucccgccuaacggcuacuuuagauucgacagcugggucaaucaguucuauacgcuugcccccaugggaaacggcaccgggcgccggagagcucuguga

SEQ ID NO: 27017 - RNA, 1623 nt, Artificial Sequence; identical to SEQ ID NO: 27016
  derived and/or modified sequence opt5 from VP1__Norovirus__AFJ21403

SEQ ID NO: 27018 - RNA, 1623 nt, Artificial Sequence; identical to SEQ ID NO: 27016
  derived and/or modified sequence opt5 from VP1__Norovirus__AFJ21404

SEQ ID NO: 27019 - RNA, 1623 nt, Artificial Sequence
  derived and/or modified sequence opt5 from VP1__Norovirus__AFJ21405
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucucuacagacaccgagaacgauuuugaaacccaucaaaauacaaaguucaccccugugggagucauucaggacggcagcacaacgcaccgcaacgagccccagcaaugggugcugcccuccuacagcggcagaaauguucacaacgugcaucuugccccugcugucgccccgaauuuucccggggaacagcuccuguucuuucggucuaccaugccuggauguuccggcuaucccaacauggaucuggacugccugcucccucaggagugggugcagcacuucuaccaagaggcggcucccgcccagagcgauguggcccugcuucgcuuuguuaacccugacacagggagaguccuguucgaauguaaacuccauaagcccggauaugugaccguggcucacacaggccagcacgaucuggucaucccgccuaauggguacuuucgguucgacucuugggugaaccaguucuauacccuugcccccaugggcaauggagcuggcagacgccgggcccuguga

SEQ ID NO: 27020 - RNA, 1623 nt, Artificial Sequence; identical to SEQ ID NO: 26522
  derived and/or modified sequence opt5 from VP1__Norovirus__AFJ21406

SEQ ID NO: 27021 - RNA, 1623 nt, Artificial Sequence
  derived and/or modified sequence opt5 from VP1__Norovirus__AFJ21407
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggguuagaaauaacuucgugcaggcucccggcggggaauuuacagucuccccucggaaugcccccggagagauccuguggucugcgccucuuggcccggaucugaaccccuaccucagccaccuggcccgcauguauaauggguacgcuggaggcuucgaagugcagguuauucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucgccggcucucacaacuacaccaugaaucucgcuucccagaacuggaauagcuaugaucccaccgaggaaaucccugcgccccugggcacaccggacuucgucgggaaaauucagggagugcuuacgcagaccacaagaaccgacggcuccacacgggggcauaaggccaccguuuacacgggaucuacagaguuuagcccuaagcugggccgcgugcaauucgcuaccgauaccaacaaugacuuugaugccaaccagaauacaaaauucacccccgucggggugauccaggacggaggcacaacgcacagaaacgaaccccaacaguggguucucccuuccuacagcggccggaauacccacaacgugcaucuggccccggcugucgcccccacauuuccuggggagcagcuucuguucuuucgcucuaccaugcccggauguuccggcuauccuaauauggaucucgacugccugcugccccaggaaugggugcaauacuucuaucaggaggcggcuccugcccagagcgauguggcccuccugagauuuguuaaccccgacacagggcggguccuuuucgaguguaagcugcacaaaucuggauacgugaccguggcucauacgggccagcacgaucucgucauuccgccuaacggguauuuuagauucgacagcugggugaaucaauucuacacccuggcccccaugggcaacggaacaggccgccggagagcucuuuga

SEQ ID NO: 27022 - RNA, 1623 nt, Artificial Sequence
  derived and/or modified sequence opt5 from VP1__Norovirus__AFJ21409
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggagauacagcccaucggaaugagccccaacagugggugcucccuucuuacagcggccgcaacucccacaauguucaccuggcgccggcuguggcccccacguuuccuggcgaacagcuucuguucuuuagaagcaccaugcccggguguucuggauauccuaacauggaccucgauugccugcugccccaggaguggguccaauacuucuaucaggaagccgcuccugcccaguccgacguggcucuccugcgguuugugaaucccgauacaggcagaguucuuuucgaguguaagcugcauaaaagcggguacgucaccguggcccacacaggacagcaugaccucgugaucccgccuaacggcuauuuucgcuucgacucuugggucaaccaauucuacacccuggcgcccauggggaauggcacgggacggagacgcgcccuuuga

SEQ ID NO: 27023 - RNA, 1623 nt, Artificial Sequence
  derived and/or modified sequence opt5 from VP1__Norovirus__AFJ21410
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucgccggcucucacaacuacaccaugaaucucgcuucccagaacuggaauagcuaugaucccaccgaggaaaucccugcgccccugggcacaccggacuucgucgggaaaauucagggagugcuuacgcagaccacaagaaccgacggcuccacacgggggcauaaggccaccguuuacacgggaucugcugaguuuagcccuaagcugggccgcgugcaauucgccacagauaccaacaaugacuuugaugccaaccagaauaccaaauucacacccgucggggugauccaggacggaggcaccacacacagaaacgaaccccaacaguggguucucccuuccuacagcggccggaauacgcacaacgugcaucuggcuccggccgucgcgcccaccuuuccuggggagcagcuucuguucuuucgcucuacaaugcccggauguuccggcuauccuaauauggaucucgacugccugcugccccaggaaugggugcaauacuucuaucaggaggcugccccugcccagagcgauguggcucuccugagauuuguuaaccccgacaccgggcggguccuuuucgaguguaagcugcacaaaucuggauacgugacaguggcccauaccggccagcacgaucucgucauuccgccuaacggguauuuuagauucgacagcugggugaaucaauucuacacgcuggcucccaugggcaacggaaccggccgccggagagcccuuuga

SEQ ID NO: 27024 - RNA, 1623 nt, Artificial Sequence; identical to SEQ ID NO: 27023
  derived and/or modified sequence opt5 from VP1__Norovirus__AFJ21411

SEQ ID NO: 27025 - RNA, 1623 nt, Artificial Sequence; identical to SEQ ID NO: 27023
  derived and/or modified sequence opt5 from VP1__Norovirus__AFJ21413

SEQ ID NO: 27026 - RNA, 1623 nt, Artificial Sequence; identical to SEQ ID NO: 26522
  derived and/or modified sequence opt5 from VP1__Norovirus__AFJ21414

SEQ ID NO: 27027 - RNA, 1623 nt, Artificial Sequence; identical to SEQ ID NO: 27023
  derived and/or modified sequence opt5 from VP1__Norovirus__AFJ21415

SEQ ID NO: 27028 - RNA, 1623 nt, Artificial Sequence; identical to SEQ ID NO: 26522
  derived and/or modified sequence opt5 from VP1__Norovirus__AFJ21416

SEQ ID NO: 27029 - RNA, 1623 nt, Artificial Sequence; identical to SEQ ID NO: 27023
  derived and/or modified sequence opt5 from VP1__Norovirus__AFJ21417

SEQ ID NO: 27030 - RNA, 1623 nt, Artificial Sequence
  derived and/or modified sequence opt5 from VP1__Norovirus__AFJ21418
augaagauggccagcuccgacgcuaaccccucugauggcagcaccgccaaucuggugccugaggucaacaaugaaguuauggcgcucgagccgguggugggggcugccaucgccgcucccgucgccggacagcaaaacauuaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucguguucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucucacaacuacaccaugaaucucgcuucccagaacuggaauagcuaugaucccaccgaggaaauuccugcgccccugggcacaccggacuucguggggaaaauccagggaguccuuacgcagaccacaagaaccgacggcuccacacgggggcauaaggccaccguguacacgggaucugcugaguuuagcccuaagcugggccgcauucaauucgccacagauaccaacaaugacuuugaugccaaccagaauaccaaauucacacccguuggggugauccaggacggaggcaccacacacagaaacgaaccccaacaguggguccucccuuccuacagcggccggaauacgcacaacgugcaucuggcuccggccguugcgcccaccuuuccuggggagcagcuucuguucuuucgcucuacacuccccggauguuccggcuauccuaauauggaucuggacugccugcucccccaggaaugggugcaauacuucuaucaggaggcugccccugcccagagcgaugucgcucugcuuagauuugugaaccccgacaccgggcgggugcuguucgaguguaagcuccacaaaucuggauacguuacagucgcccauaccggccagcacgaucuggugauuccgccuaacggguauuuuagauucgacagcugggugaaucaauucuacacgcuugcucccaugggcaacggaaccggccgccggagagcccuguga

SEQ ID NO: 27031 - RNA, 1623 nt, Artificial Sequence
  derived and/or modified sequence opt5 from VP1__Norovirus__AFJ21419
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucucacaacuacaccaugaaucucgccucccagaacuggaauagcuaugaucccacagaggaaauuccugcuccccugggcacgccggacuucguggggaaaauccagggaguccuuacccagacaaccagaacagacggcuccacccgggggcauaaggcgacgguguacacaggaucugccgaguuuagcccuaagcugggccgcguucaauucgcuaccgauaccaacaaugacuuugaugccaaccagaauacaaaauucacccccgugggggucauucaggacggaggcacaacgcacagaaacgaaccccaacagugggugcucccuuccuacagcggccggaauacccacaacguucaucuggccccggcuguggcccccacauuuccuggggagcagcuucuguucuuucgcucuaccaugcccggauguuccggcuauccuaauauggaucucgacugccugaucccccaggaauggguccaauacuucuaucaggaggcggcuccugcccagagcgauguggcccugcucagauuugugaaccccgacacagggcggguucuguucgaguguaaacuucacaagucuggauacgucaccguggcucauacgggccagcacgaucuggugauuccgccuaacggguauuuuagauucgacagcugggucaaucaauucuacacccucgcccccaugggcaacggaacaggccgccggagagcucuguga

SEQ ID NO: 27032 - RNA, 1623 nt, Artificial Sequence; identical to SEQ ID NO: 27023
  derived and/or modified sequence opt5 from VP1__Norovirus__AFJ21420

SEQ ID NO: 27033 - RNA, 1623 nt, Artificial Sequence
  derived and/or modified sequence opt5 from VP1__Norovirus__AFJ21421
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcgguggucccucccaauuuuccuaccgagggacugucccccucucaggugacaauguucccgcauaucaucguggacgucagacaacucgagccuguucugauuccccugccugaugugcggaacaauuuuuaucacuacaaccagagcaaugaccccaccaucaagcucauugccaugcuguauacaccccuucgcgcuaacaacgccggcgaugacguguucaccgucuccugcagagugcugacacggccuagcccggauuuugacuucaucuuucucguucccccuaccguggaaucucgcacgaaacccuucuccgucccuauucugaccguggaggaaaugacaaauagcagauuucccaucccgcuugagaagcuguucaccgggccuucuuccgcuuucguugugcagccccagaacggacgguguacaaccgauggcguccuccuggggacgacacaacugagcccugugaauauuugcaccuuucgcggagacgucacacauaucgccggcucucacaacuacaccaugaaucucgccucccagaacuggaauagcuaugaucccaccgaggaaaucccugcuccccugggcacaccggacuucguggggaaaauucagggaguucuuacgcagaccacaagaaccgacggcuccacacgggggcauaaggcgaccguguacacgggaucugccgaguuuagcccuaagcugggccgcguccaauucgcuacagauaccaacaaugacuuugaugccaaccagaauaccaaauucacacccguggggguuauccaggacggaggcaccacacacagaaacgaaccccaacagugggugcucccuuccuacagcggccggaauacgcacaacguccaucuggccccggcuguggcccccaccuuuccuggggagcagcuucuguucuuucgcucuacaaugcccggauguuccggcuauccuaauauggaucucgacugccugcugccccaggaaugggugcaauacuucuaucaggaggcggcuccugcccagagcgauguugcccuccugagauuugucaaccccgacaccgggcgggugcuuuucgaguguaagcugcacaaaucuggauacgugacagucgcucauauuggccagcacgaucucgugaucccgccuaacggguauuuuagauucgacagcuggguuaaucaauucuacacccuggcccccaugggcaacggaacgggccgccggagagcucuuuga

SEQ ID NO: 27034 - RNA, 1623 nt, Artificial Sequence; identical to SEQ ID NO: 27023
  derived and/or modified sequence opt5 from VP1__Norovirus__AFJ21422

SEQ ID NO: 27035 - RNA, 1623 nt, Artificial Sequence; identical to SEQ ID NO: 26518
  derived and/or modified sequence opt5 from VP1__Norovirus__AFJ21423

SEQ ID NO: 27036 - RNA, 1623 nt, Artificial Sequence; identical to SEQ ID NO: 26522
  derived and/or modified sequence opt5 from VP1__Norovirus__AFJ21424

SEQ ID NO: 27037 - RNA, 1623 nt, Artificial Sequence
  derived and/or modified sequence opt5 from VP1__Norovirus__AFJ21425
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauaacuaugauccuaccgaggaaauccccgcuccgcugggcacaccugacuucgucgggaaaauucagggagugcuuacgcagaccacacggaccaauggcagcacacgcgggcacaaggcgaccguuuacacgggauccgccgacuuuucucccaagcugggcagagugcaauucgcuacagauaccgacaacgauuuugagaccaaucagaacacaaaauucacccccgucggggugauccaggacggaagcacaacgccucggaaugaaccgcaacaguggguucuccccuccuacagcggccgcaacauucauaaugugcaccuggccccugccgucgcucccaccuuuccuggcgagcagcuucuguucuuuagaucuacaaugcccggguguuccggauauccuaacauggaucucgacugccugcugccccaggaaugggugcaauacuucuaucaggaggccgcgccggcucagagcgauguggcccuccugcgguuuguuaacccugacaccggcagaguccuuuucgaguguaagcugcacaaaucuggguacgugacaguggcccauaccggacagcacgaucucgucauucccccuaauggcuauuuucgcuucgacagcugggugaaccaauucuacacgcuggcucccauggggaauggcaccggacggagacgcgcccuuuga

SEQ ID NO: 27038 - RNA, 1623 nt, Artificial Sequence; identical to SEQ ID NO: 26522
  derived and/or modified sequence opt5 from VP1__Norovirus__AFJ21426

SEQ ID NO: 27039 - RNA, 1623 nt, Artificial Sequence
  derived and/or modified sequence opt5 from VP1__Norovirus__AFJ21428
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccugcugaggaaauccccgcgccucugggcacccccgacuucgucgggaaaauucagggagugcuuacacagacgacccggacaaauggcagcacccgcgggcacaaggccacaguuuacaccggauccgcugacuuuagcccgaagcugggcagagugcaauucgccacggauacagacaaugauuuugagaccaaccagaauaccaaauucacaccugucggggugauccaggacggaucuaccacaccccggaacgaaccccaacaguggguucucccuuccuacagcggccgcaauauucauaacgugcaccuggccccggcugucgcccccacguuuccuggcgagcagcuucuguucuuuagaucuaccaugcccggguguagcggauauccuaauauggaucucgacugccugcugccccaggaaugggugcaauacuucuaucaggaggcggcuccugcccaguccgauguggcccuccugcgguuuguuaaccccgacacaggcagaguccuuuucgaguguaagcugcacaaaucuggguacgugaccguggcucauacaggacagcacgaucucgucaucccgccuaacggcuauuuucgcuucgacagcugggugaaucaauucuacacccuggcccccauggggaacggcacgggacggagacgcgcucuuuga

SEQ ID NO: 27040 - RNA, 1623 nt, Artificial Sequence; identical to SEQ ID NO: 26522
  derived and/or modified sequence opt5 from VP1__Norovirus__AFJ21429

SEQ ID NO: 27041 - RNA, 1623 nt, Artificial Sequence; identical to SEQ ID NO: 26522
  derived and/or modified sequence opt5 from VP1__Norovirus__AFJ21430

SEQ ID NO: 27042 - RNA, 1623 nt, Artificial Sequence; identical to SEQ ID NO: 26522
  derived and/or modified sequence opt5 from VP1__Norovirus__AFJ21431

SEQ ID NO: 27043 - RNA, 1623 nt, Artificial Sequence
  derived and/or modified sequence opt5 from VP1__Norovirus__AFJ21432
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauacccccggcucucacaacuacaccaugaaucucgccucccagaacuggaauagcuaugauccuacagaggaaauccccgcuccgcugggcacgccugacuucgucgggaaaauccagggagugcuuacccagacaaccagaacaaacggcuccacccgggggcauaaggcgacgguuuacacaggaucugccgacuuuagccccaagcugggccgcgugcaauucgcuaccgauaccgacaaugauuuugagacaaaccagaauaccaaauucacacccgucggggugauucaggacggauccacgaccccuagaaacgaaccgcaacaguggguucuccccagcuacucuggccggaauauccacaacgugcaccuggccccugccgucgcucccacauuuccuggcgagcagcuucuguucuuucgcuccaccaugcccggguguagcggauauccuaauauggaucucgacugccugcugccccaggaaugggugcaauacuucuaucaggaggccgcgccggcucagucugauguggcccuccugagauuuguuaacccugacacaggccggguccuuuucgaguguaagcugcauaaaagcggguacgugaccguggcccacacgggacagcaugaucucgucauucccccuaacggcuauuuuagauucgacuccugggugaaucaauucuacacccuggcucccauggggaacggcacaggacgccggagagcccuuuga

SEQ ID NO: 27044 - RNA, 1623 nt, Artificial Sequence
  derived and/or modified sequence opt5 from VP1__Norovirus__AFJ21433
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccguccaggagaugacaaauagcagauuucccaucccgcuugaaaagcuguucaccgggccuucuuccgccuucgugguucagccccaaaacggacgguguacaaccgauggcgugcuccuggggacgacacagcugagcccugucaauauuugcaccuuucgcggagacgugacacauauccccggcucuagaaacuacaccaugaaucucgccucccagaacuggaauagcuaugauccuaccgaggagauccccgcuccgcugggcacaccugacuucgucgggaaaauucagggagugcuuacgcaaaccacacggaccaacggcuccacacgcgggcacaaggcgaccguuuacacgggaucugccgacuuuagccccaagcugggcagagugcaguucgcuacagauaccgacaaugauuuugaaaccaaccagaauacaaaauucacccccgucggggugauccaagacggauccacaacgccucggaacgagccgcagcaguggguucuccccagcuacucuggccgcaauauucauaacgugcaccuggccccugccgucgcucccaccuuuccuggcgaacagcuucuguucuuuagauccacaaugcccggguguagcggauauccuaauauggaucucgacugccugcugccccaagagugggugcaguacuucuaucaggaagccgcgccggcucagucugauguggcccuccugcgguuuguuaacccugacaccggcagaguccuuuucgaguguaagcugcacaaaagcggguacgugacaguggcccauaccggacaacacgaucucgucauucccccuaacggcuauuuucgcuucgacuccugggugaaucaguucuacacgcuggcucccauggggaacggcaccggacggagacgcgcccuuuga

SEQ ID NO: 27045 - RNA, 1623 nt, Artificial Sequence
  derived and/or modified sequence opt5 from VP1__Norovirus__AFJ21434
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcagaccacacggaccaauggcagcacacgcgggcacaaggcgaccguuuacacgggauccgccgacuuuagcccgaagcugggcagagugcaauucgcuacagauaccgacaaugauuuugagaccaaccagaauacaaaauucaccccugucggggugauccaggacggaucuacaacgccccggaacgaaccccaacaguggguucucccuuccuacagcggccgcaauauucauaacgugcaccuggccccggccgucgcucccaccuuuccuggcgagcagcuucuguucuuuagaucuacaaugcccggguguagcggauauccuaauauggaucucgacugccugcugccccaggaaugggugcaauacuucuaucaggaggccgcgccugcucaguccgauguggcccuccugcgguuuguuaaccccgacaccggcagaguccuuuucgaguguaagcugcacaaaucuggguacgugacaguggcccauaccggacagcacgaucucgucaucccgccuaacggcuauuuucgcuucgacagcugggugaaucaauucuacacgcuggcucccauggggaacggcaccggacggagacgcgcccuuuga

SEQ ID NO: 27046 - RNA, 1623 nt, Artificial Sequence; identical to SEQ ID NO: 26522
  derived and/or modified sequence opt5 from VP1__Norovirus__AFJ21436

SEQ ID NO: 27047 - RNA, 1623 nt, Artificial Sequence; identical to SEQ ID NO: 27045
  derived and/or modified sequence opt5 from VP1__Norovirus__AFJ21437

SEQ ID NO: 27048 - RNA, 1623 nt, Artificial Sequence
  derived and/or modified sequence opt5 from VP1__Norovirus__AFJ21438
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaucggacaguaugaucucgucauucccccuaacggcuacuuucgcuucgacuccugggugaaucaauucuauacccuggcucccauggggaacggcacgggacggagacgcgcccuuuga

SEQ ID NO: 27049 - RNA, 1623 nt, Artificial Sequence; identical to SEQ ID NO: 26518
  derived and/or modified sequence opt5 from VP1__Norovirus__AFJ21439

SEQ ID NO: 27050 - RNA, 1623 nt, Artificial Sequence
  derived and/or modified sequence opt5 from VP1__Norovirus__AFJ21440
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacgggcgaacggcuccacccgcgggcacaaggccacaguuuacaccggaucugcugacuuuagccccaagcugggcagagugcaauucgccacggauacagacaaugauuuugagaccaaccagaauaccaaauucacacccgucggggugauccaggacggauccaccacaccucggaacgaaccgcaacaguggguucuccccagcuacucuggccgcaauauucauaacgugcaccuggccccugcugucgcccccacguuuccuggcgagcagcuucuguucuuuagauccaccaugcccggguguagcggauauccuaauauggaucucgacugccugcugccccaggaaugggugcaauacuucuaucaggaggcggcuccggcccagucugauguggcccuccugcgguuuguuaacccugacacaggcagaguccuuuucgaguguaagcugcacaaaagcggguacgugaccguggcucauacaggacagcacgaucucgucauucccccuaacggcuauuuucgcuucgacuccugggugaaucaauucuacacccuggcccccauggggaacggcacgggacggagacgcgcucuuuga

SEQ ID NO: 27051 - RNA, 1623 nt, Artificial Sequence
  derived and/or modified sequence opt5 from VP1__Norovirus__AFJ21441
augaagauggccagcuccgacgcuaaccccucugauggcagcaccgccaaucuggugccugaggucaacacagaaguuauggcgcucgagccgguggugggggcugccaucgccgcucccgucgccggacagcaaaaugugaucgacccuuggaucagaaacaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgaccccacaauuaagcucaucgcuaugcuguauacaccccuucgcgccaauaacgcuggcgaugacguuuucaccguguccugcagagugcugacccggccuagcccggauuuugacuucauuuuucucgugcccccuacggucgaaucucgcaccaaacccuucuccguuccugugcugacagucgaggaaaugaccaacagcagauuucccaucccgcuugagaagcuguucacagggccuucuuccgccuucgugguucagccccagaauggacgguguaccacggauggcgugcuccuggggacaacccaacugagcccugucaacauuugcacauuucgcggagacgugacccauauccccggcucuagaaauuacaccaugaaccucgccucccagaauuggaacagcuaugauccuacagaggaaauccccgcuccgcugggcacgccugacuucgucgggaaaauucagggagugcuuacccagacaacccggacaaauggcuccacccgcgggcacaaggcgacgguuuacacaggaucugccgacuuuagccccaagcugggcagagugcaauucgcuaccgauaccgacaacgauuuugagacaaaucagaacaccaaauucacacccgucggggugauccaggacggauccacgaccccucggaaugaaccgcaacaguggguucuccccagcuacucuggccgcaacauucauaaugugcaccuggccccugccgucgcucccacauuuccuggcgagcagcuucuguucuuuagauccaccaugcccggguguagcggauauccuaacauggaucucgacugccugcugccccaggaaugggugcaauacuucuaucaggaggccgcgccggcucagucugaugccgcccuccugcgguuugugaauccugacacaggcagaguucuuuucgaguguaagcugcacaaaagcggguacgucaccguggcucauacgggacagcacgaucucgugauucccccuaacggcuauuuucgcuucgacuccugggucaaccaauucuacacccuggcccccauggggaauggcacaggacggagacgcgcucuuuga

SEQ ID NO: 27052 - RNA, 1623 nt, Artificial Sequence
  derived and/or modified sequence opt5 from VP1__Norovirus__AFJ21442
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaauccuucacgguuccuauccugaccguggaggaaaugacaaacagcagauuucccauuccucuugagaagcuguucaccgggcccucuuccgccuucgucgugcagccgcagaauggacgguguacaaccgauggcguucuccuggggacgacacaacugagcccugugaacaucugcaccuuucgcggagacgucacacauaucgcuggcucuagaaauuacaccaugaaccucgcgucccugaauuggaacaauuaugaucccaccgaggaaauuccugcuccccuuggcacaccugacuucguggggaaaauccagggaguccugacgcagaccacaaagggcgacgggagcacccggggacacaaggccacaguguacaccggcuccgccgauuuuacgcccaaacucgggucuguucaguucggaacagacaccgauaacgacuuugagacccaucaaaauacaaaguucaccccggugggcgucauucaggauggcagcacaacgcaccgcaacgaaccucagcaaugggugcugcccuccuacagcgggagaaauguucacaacgugcaucuugcccccgcugucgccccuaauuuuccgggagagcagcuccuguucuuucggucuaccaugcccggcuguuccggguauccuaacauggaccuggauugccugcucccccaggaaugggugcagcacuucuaccaagaggcggcuccugcccagagcgacguggcccugcuucgcuuuguuaaccccgauacaggaagaguccuguucgaguguaaacuccauaagucuggcuaugugaccguggcucacacagggcagcacgaccuggucaucccucccaauggcuacuuucgguucgauagcugggugaaccaguucuauacccuugccccgaugggaaauggcgcugggagaaaacgcgcccuguga

SEQ ID NO: 27053 - RNA, 1623 nt, Artificial Sequence
  derived and/or modified sequence opt5 from VP1__Norovirus__AFJ21443
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaugaucgucgacgugagacaacucgagccugugcugauuccccugccugauguccggaacaauuuuuaucacuacaaccagagcaaugaccccaccaucaagcucauugcuaugcuguauacaccccuucgcgccaacaacgcuggcgaugacguuuucaccguguccugcagagugcugacacggccuagcccggauuuugacuucaucuuucucgugcccccuaccgucgaaucucgcacgaaacccuucuccguuccugugcugaccgucgaggaaaugacaaauagcagauuucccauuccgcuugagaagcuguucaccgggccuucuuccgccuucgugguucagccccagaacggacgguguacaaccgauggcgugcuccuggggacgacacaacugagcccugucaauaucugcaccuuucgcggagacgugacacauacccccggcucucacaacuacaccaugaaucucgccucccagaacuggaauagcuaugauccuacagaggaaauucccgcuccgcugggcacgccugacuucgucgggaaaauccagggagugcuuacccagacaaccagaacaaacggcuccacccgggggcauaaggcgacgguuuacacaggaucugccgacuuuagccccaagcugggccgcgugcaauucgcuaccgauaccgacaaugauuuugagacaaaccagaauaccaaauucacacccgucggggugauccaggacggauccacgaccccuagaaacgaaccgcaacaguggguucuccccagcuacucuggccggaauauucacaacgugcaccuggccccugccgucgcucccacauuuccuggcgagcagcuucuguucuuucgcuccaccaugcccggguguagcggauauccuaauauggaucucgacugccugcugccccaggaaugggugcaauacuucuaucaggaggccgcgccggcucagucugauguggcccuccugagauuuguuaacccugacacaggccggguccuuuucgaguguaagcugcauaaaagcggguacgugaccguggcccacacgggacagcaugaucucgucauucccccuaacggcuauuuuagauucgacuccugggugaaucaauucuacacccuggcucccauggggaacggcacaggacgccggagagcccuuuga

SEQ ID NO: 27054 - RNA, 1623 nt, Artificial Sequence
  derived and/or modified sequence opt5 from VP1__Norovirus__AFJ21444
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaccgccggcucucacaacuacaccaugaaucucgcuucccagaacuggaauagcuaugaucccacagaggaaaucccugcgccccugggcacgccggacuucguggggaaaauucagggaguccuuacccagacaaccagagccgacggcuccacacgggggcauaaggcuaccguguacacgggaucugccgaguuuagcccuaagcugggccgcguucaauucgccacagauaccgacaacgauuuugacgcuaaucagaacaccaaauucacacccgugggggucauccaggauggaggcaccacacacagaaaugaaccccaacagugggugcucccuuccuacagcggccggaacacgcacaauguucaucuggccccggcgguggcucccaccuuuccuggggagcagcuucuguucuuucgcucuacaaugcccggauguuccggcuauccuaacauggaccucgauugccugcugccccaggaauggguccaauacuucuaucaggaggccgccccugcucagagcgacguggcccuccugagauuugugaaucccgauaccgggcggguucuuuucgaguguaagcugcacaaaucuggauacgucacaguggcucauaccggccagcacgaccucgugauuccgccuaacggguauuuuagauucgauagcugggucaaccaauucuacacgcuggcccccaugggcaauggaaccggccgccggagagcgcuuuga

SEQ ID NO: 27055 - RNA, 1623 nt, Artificial Sequence; identical to SEQ ID NO: 26522
  derived and/or modified sequence opt5 from VP1__Norovirus__AFJ21445

SEQ ID NO: 27056 - RNA, 1623 nt, Artificial Sequence
  derived and/or modified sequence opt5 from VP1__Norovirus__AFJ21446
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccgugccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauucccggcucuagaaacuacaccaugaaucucgccucccagaacuggaauagcuaugauccuaccgaggaaauccccgcuccgcugggcacaccugacuucguggggaaaauccagggaguucuuacgcagaccacacggaccaacggcuccacacgcgggcacaaggcgaccguguacacgggaucugccgacuuuagccccaagcugggcagaguccaauucgcuacagauaccgacaaugauuuugagaccaaccagaauacaaaauucacccccguggggguuauucaggacggauccacaacgccucggaacgaaccgcaacagugggugcuccccagcuacucuggccgcaauauccauaacguccaccuggccccugccguggcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguugcccuccugcgguuugucaacccugacaccggcagagugcuuuucgaguguaagcugcacaaaagcggguacgugacagucgcccauaccggacagcacgaucucgugauucccccuaacggcuauuuucgcuucgacuccuggguuaaucaauucuacacgcuggcucccauggggaacggcaccggacggagacgcgcccuuuga

SEQ ID NO: 27057 - RNA, 1623 nt, Artificial Sequence; identical to SEQ ID NO: 26522
  derived and/or modified sequence opt5 from VP1__Norovirus__AFJ21448

SEQ ID NO: 27058 - RNA, 1623 nt, Artificial Sequence
  derived and/or modified sequence opt5 from VP1__Norovirus__AFJ21451
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagacacugugguccgccccucuuggcccggaucugaaucccuaccucucucaccuggcucgcauguauaacggguacgccggaggcuucgaaguccaggugauucuugcuggcaaugccuuuacggcggggaaaaucauuuucgccgcuguuccucccaacuuuccuaccgagggacugagccccucccaggugacaauguucccgcauaucaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaugacguuuucaccguguccugcagagugcugacacggcccagcccugauuuugacuucaucuuucucgucccgcccaccguggaaucucgcacgaaaccuuucaccguucccauucugacaguggaggaaaugaccaacuccagauuuccuaucccccuugagaagcuguucacagggccgagcucugccuucgucgugcagccucagaauggacgguguaccacggauggcguucuccuggggacaacccaacugucccccgugaacauuugcacauuucgcggagacgucacccauaucgcuggcagcagaaauuacaccaugaaccucgcgucucugaauuggaacaauuaugauccuacagaggaaauccccgccccucuuggcacgcccgacuucguggggaaaauucagggaaugcugacccagacaacccagggcgacggguccacacggggacacaaggcuaccgucuacacgggcagcgccgauuuuacaccgaagcucggguccgugcaauucgccaccgacaccgagaacgauuuugaaacacaucagaauaccaaauucacaccuguuggagugauccaggacggcucuacgacccaccgcaacgagccccaacagugggcucugcccagcuacuccggcagaagcgcccacaauguccaucuugcgccugcuguggccccgaacuuucccggggaacagcuccuguucuuucggucuacaaugccuggauguuccggcuaucccaauauggaucuggacugccugcucccucaggaguggguucaacacuucuaccaggaggccgcucccgcccagagcgauguggcucugcuucgcuuugucaacccugacaccgggagagugcuguucgaauguaagcuccauaaaucuggauaugugacaguugcccacaccggccagcacgaucuggucauucccccgaacggguacuuucgguucgacagcugggugaaucaauucuauacgcuugcgccuaugggcaacggaaccggcagacgccgggcccuguga

SEQ ID NO: 27059 - RNA, 1623 nt, Artificial Sequence
  derived and/or modified sequence opt5 from VP1__Norovirus__AFJ21454
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccucuuccagaaacuacaccaugaaucucgccagccagaacuggaacuccuaugauccuaccgaggaaauccccgcuccgcugggcacaccugacuucgucggcaaaauucagggggugcuuacgcagaccacacggaccgacggaucuacacgcggccacaaggcgaccguuuacacggggagcgccgauuuuucccccaagcugggaagagugcaauucgcuacagacaccgauaaugacuuugagaccaaucagaacacaaaauucacccccgucggcgugauccaggaugggagcacaacgcaucggaaugaaccucaacaguggguucucccgucuuacuccggacgcaacauucacaaugugcaccuggcccccgccgucgcuccuaccuuucccggcgagcagcuucuguucuuuagaagcacaaugccuggcuguucuggguaucccaacauggaccucgauugccugcugccucaggaaugggugcaauacuucuaucaggaggccgcgcccgcucagagcgacguggcccuccugcgguuuguuaauccggauaccggaagaguccuuuucgaguguaagcugcauaaauccggcuacgugacaguggcccacaccgggcagcaugaccucgucaucccucccaacggauauuuucgcuucgauucuugggugaaccaauucuacacgcuggcuccuaugggcaaugggaccggccggagacgcgcccuuuga

SEQ ID NO: 27060 - RNA, 1623 nt, Artificial Sequence
  derived and/or modified sequence opt5 from VP1__Norovirus__AFL70023
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucgcccaccuggcucgcauguauaacggguacgccggaggcuucgaaguccaggugauccuugcuggcaaugccuuuacggcggggaaaauuaucuucgccgcuguuccucccaacuuuccuaccgagggacugucucccagccaggugacaauguucccgcauaucgucguggacgugagacaacucgagccuguccugauuccccugccugauguuggcaauaacuuuuaucacuacaaucaguccaacgaccccaccaucaagcucauugccaugcuguauacaccccuucgggcuaacaaugccggggaagauguguucaccgugucuugccgcguccugacaagaccuagcccggacuuugauuucaucuuucucgugcccccuaccguugagucccggacgaaacccuucaccgugccuauucugacagucgaagagaugaccaacagccgcuuucccaucccgcuugagaagcuguucacaggaccuucuggcgccuucgugguucagccccagaaugggagauguaccacggacggagugcuccugggcacaacccaacuguccccugucaacauuugcacauuucggggcgaugugacccauaucgcugggacccacaauuacacaaugaaccucgcgagccagaauuggaacaauuaugaccccacggaagagaucccugcuccccugggaaccccggauuucgucggccgcauucaggggaugcuuacacagaccacaagaggagacggcucuacccgggggcauaaagccacgguguccacaggagacguucacuuuaccccuaagcugggcagcauccaauucaacaccgauacaaauaacgacuuugaaaccggccagaauacaaaguucacgcccgugggggucgugcaggauggaaacggcgcccaccaaaaugagccccagcaguggguucucccuucuuacuccgggcgcaccggacauaacgugcaccuggccccggcugucgcccccacauuuccuggcgaacagcuucuguucuuuagaagcaccaugcccggguguuccggcuacccuaacaugaaucucgacugccugcugccccaagagugggugcagcauuucuaucaggaggcggcuccugcccagucugauguggcccuccugcgguuuguuaaccccgacacaggacgcguccuuuucgaauguaaacugcacaagagcggcuacgugaccguggcucacacggggcaacaugaucucgucauuccgccuaauggauauuuuagauucgacuccugggugaaccaguucuacacccuggcccccaugggcaaugggacaggacggagacgcgcucuuuga

SEQ ID NO: 27061 - RNA, 1653 nt, Artificial Sequence
  derived and/or modified sequence opt5 from VP1__Norovirus__AFN06724
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaucuacccccagaaugcggcuuauugcuaugcuguacacaccucuccgcgccaauagcggggaggauguuuuuaccguguccuguagagugcugacacggcccgcucccgacuucgaguuuaccuuccuugucccuccgacaguggaaagcaagaccaaacccuuuacgcugccuauccucacccugggagagcugucuaacucccgcuuccccgccgccauugauaugcucuauacagacccuaacgaaagcaucguugugcaaccccagaauggcagaugcacccuggaugggacacuucagggaaccacgcagcuggucccgacacaaauuugugcuuuucggggcacccucaucucucagacagcgcgcgccgcugacuccaccgauagcccucagagagcccgggaccacccccugcaugugcaaguuaagaaccuugaugggacccaguacgacccuacagacgauauccccgccgugcugggagcuauugacuucaaaggcacggucuucggcguggccucucagcgcgaugucuccgggcagcaagagcagggacacuaugcgaccagagcucacgaagcccauaucgacacaaccgauccuaaguacgcccccaagcucggcacaauucugaucaaaagcgaguccaaugacuuuaccacgaaccagccgauucgguucacaccuguggggaugggagauaauaacuggagacagugggagcugcccgacuacucuggccgccucacccugaauaugaaccuugcucccgccguuagcccuuccuuuccgggggaacggauccuguucuuuagaagcaucgugcccucugcuggaggcuucggcuccggguauauugauugccucaucccucaagaguggguccagcacuuuuaccaggaagccgcgcccagccagucugccguggcucugguucgcuaugugaauccugacaccggacggaacauuuucgaggccaaacuucauagagaaggcuuucugacagucgcuaauagcgggaacaaucccaucguggugccucccaacggauacuuccgcuuugaggccuggguuaaucaauucuauacccucgcgccgaugggcuccgggcagggccggagacgcgcccaguga

SEQ ID NO: 27062 - RNA, 1653 nt, Artificial Sequence
  derived and/or modified sequence opt5 from VP1__Norovirus__AFN06725
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuauugcuaugcuguacacaccucuccgcgccaacucuggggaggauguuuuuaccgugagcuguagagugcugacacggcccgcucccgacuucgaguuuaccuuccuugucccuccgacaguggaauccaagaccaaacccuuuacgcugccuauccucacccugggagagcugagcaacucucgcuuccccgccgccauugauaugcucuauacagacccuaaugaauccaucguugugcaaccccagaacggcagaugcacccuggaugggacacuucagggaaccacgcagcuggucccgacacaaauuugugcuuuucggggcacccucaucagccagacagcgcgcgccgcugacucuaccgauuccccucagagagcccgggaccacccccugcaugugcaaguuaagaaucuugaugggacccaguacgacccuacagacgauauccccgccgugcugggagcuauugacuucaaaggcacggucuucggcguggccagccagcgcgaugucucugggcagcaagagcagggacacuaugcgaccagagcucacgaagcccauaucgacacaaccgauccuaaguacgcccccaagcucggcacaauucugaucaaauccgagagcaacgacuuuaccacgaaucagccgauucgguucacaccuguggggaugggagauaacaauuggagacagugggagcugcccgacuacuccggccgccucacccugaacaugaaucuugcucccgccguuucuccuagcuuuccgggggaacggauccuguucuuuagauccaucgugcccagcgcuggaggcuucggcucuggguauauugauugccucaucccucaagaguggguccagcacuuuuaccaggaagccgcgcccucccagagcgccguggcucugguucgcuaugugaacccugacaccggacggaauauuuucgaggccaaacuucauagagaaggcuuucugacagucgcuaacucugggaauaaccccaucguggugccucccaauggauacuuccgcuuugaggccuggguuaaccaauucuauacccucgcgccgaugggcagcgggcagggccggagacgcgcccaguga

SEQ ID NO: 27063 - RNA, 1629 nt, Artificial Sequence
  derived and/or modified sequence opt5 from VP1__Norovirus__AFN06726
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagagcgaauuucgugcaagcccccaacggggaauuuaccgucuccccucggaaugcucccggagaggugcuucugaaccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcaggauaaugaccaccuuuauaacaucaccauuaccaaucugaacggcagcccguucgacccuucugaagauauccccgcgccucucggggugcccgacuuccaaggacgcgucuuuggcgugauuacacagagagauaagcagaaugccgcugggcaaucccagccugccaaccggggacacgacgccgucgugcccacguacaccgcucaguacacaccgaaacugggccagguucaaaucgggaccuggcagacagaugaccugaaggugaaucagccugucaaauucacccccgugggacucaacgauacggagcacuuuaaucaguggguugugccccgcuaugccggcgcgcugaaccuuaauacaaaccuggcuccuagcgucgccccgguguuccccggcgaaagacuccuguuuuuccgguccuaccuuccucugaaagggggauauggcaaucccgccaucgacugccuccugccucaagagugggugcagcauuuuuaccaggaggcugcccccucuaugagcgaaguugcucugguccgcuauauuaacccugauaccgggagagcccucuucgaggcgaagcugcaccgggccggauuuaugaccguguccagcaauacaucugcucccguggucgugccggccaacggcuacuucagauuugacuccuggguuaaccaguucuauagccuugcuccuauggggaccggcaauggacgccggagaauccaauga

SEQ ID NO: 27064 - RNA, 1617 nt, Artificial Sequence
  derived and/or modified sequence opt5 from VP1__Norovirus__AFN06727
augaagauggccagcaacgacgcuacccccuccgaugacggcgccgcggggcuggugccugagaucaauaacgaagucauggcucucgagccgguugccggagccucuauugcugcccccguggugggccagcaaaauaucauugauccuuggaucagaaacaauuucguccaggcucccgccggggaauuuacagugagcccucggaacucccccggagagcugcuucuggaccucgaacugggcccugagcuuaauccguaccuggcgcaccucgcccgcauguauaacgggcaugcuggaggcauggagguucagauugugcuggccggcaaugcuuucacggccgggaaaauccuguuugcggccauucccccuucuuuccccuacgaaaaccucagcccugcucagcugaccaugugcccccacgucaucguggauguuagacaacuugagccggugcugcucccuaugcccgacauccggaaugucuuuuaucauuacaaccagaauaacuccccuaagcugcgccuuguggccaugcuguauacaccccucagagcuaauaacucuggagaugacguguucaccgucagcugucggguucugacacgccccuccccugauuuucaguucaccuuucuggugccgcccacaguggaaagcaaaaccaagaacuucacgcucccuguccugagagugucugagaugaccaauucccgguuucccguugugcuugaccagauguacacaagccgcaacgagaauauuaucguccaaccucagaacggcagaugcaccacagauggggaacugcucggaaccacgauucugcagucuguguccaucuguaauuucaaaggcacaaugcaggccgagcuuagcgaccaaccccgguaucaguaccagcugcaacucaccaaccuggaugggucuccgauugacccuacagacgauguucccgccccucugggaacccccgacuuucaggcuaugcucuacggcguggcgucccagcgcagcuccagagauaaugccacccgggcucacgacgcccagaucgauacagccggcgacacguucgcuccuaagaucgggcaaguccgcuucaagucuagcuccaacgauuuugaccugcaugaucccaccaaauucacaccgauuggagugaaugucgacgaucagcacccuuuuagacaguggagccuucccaacuauggcgggcaccuggcccucaauaaccaucuggcgcccgcugugaccccucuuuucccgggagaacagauccuguuuuuccggucuuacauucccuccgccggcgggcacacagacggagccauggacugccuccugccucaagaguggaucgaacauuuuuaucaggagagcgcucccucucagagcgauauugcccugguuagauucaucaauccugacaccggccgcgugcucuuugaggcuaagcugcacaaacagggcuuccuuacgaucgccgcguccggggaucaccccauugucaugccuacaaacggauacuuucgguucgaagccugggugaaucccuuuuauacccuggcuccgguuggcaccgggucuggaagacgccggauccaauga

SEQ ID NO: 27065 - RNA, 1647 nt, Artificial Sequence
  derived and/or modified sequence opt5 from VP1__Norovirus__AFN06728
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucacccugcccauccucacgauuucugaaauguccaacagcagauuuccugugcccaucgacucucugcauaccuccccuacagagaauaucgugguccagugccagaacggacgggugacccuggauggcgagcucauggggacaacccaacugcuucccagccagauuugugcguuccgcggaacgcugacaagaucuaccucccgggccagcgaccaggcugauacagccaccccgcgccucuucaauuauuacuggcacauccagcuggacaaccuuaauggcaccccuuaugaccccgccgaagauauuccugcuccccugggcacaccugacuuuagagggaagguuuucggaguggccucccaacggaaccccgauucuacgacccgcgcgcaugaggcuaaagucgacacaaccagcggcagauuuacaccgaagcucgggucccuggaaaucagcaccgagucugaugacuucgauccuaaucagcccacgcgguuuacacccgugggaauuggcguugacaacgaagccgauuuccagcaauggucccugccugacuacagcgggcaguuuacccacaauaugaaccucgccccggcuguggcccccaauuucccuggagagcagcugcuguuuuucagaucucagcuucccagcuccggcggccgcucuaacgggauccucgauugccuggucccucaagagugggugcagcacuuuuaccaggaaagcgcucccgcccagacccaagucgcgcuugugcgguauguuaacccugacacaggaagagugcuguucgaggccaagcuccauaaacugggcuuuaugaccaucgcuaagaauggggacucccccauuacagucccgccuaacggauacuuccgcuucgaaagcugggugaaucccuuuuauacgcuggccccuaugggcaccgggaacggccggagacgcauccaguga

SEQ ID NO: 27066 - RNA, 1647 nt, Artificial Sequence
  derived and/or modified sequence opt5 from VP1__Norovirus__AFN06729
augaagauggccagcaacgacgcugcccccuccaaugauggcgcggcugggcuggugccugagaucaacaaugaagccauggcccucgagccggucguuggagcugccauugcugcgccccugaccggccagcaaaacaucauugacccuuggaucaugaauaacuucgugcaggcccccgggggagaauuuacagugucuccuagaaauagccccggcgagguccuucugaaccucgaacuggggccugagauuaauccguaccuugcccaccuggcucggauguauaacggauacgccggcggcuucgaggugcagguugugcucgcugggaaugccuuuacggcgggaaaagucaucuucgccgcuauucccccuaacuuucccaucgauaaucuguccgccgcucagaucaccaugugcccucaugugauuguugacgugcgccaacuggaacccaucaaccucccgaugccugaugucagaaauaacuucuuucacuauaaccagggcucugacagccggcugcgccuuauugccaugcuguacacaccccucagagccaauaacuccggggaugacguguucaccgugucuugucggguccugacacgcccuagccccgauuuuuccuucaauuuucuuguucccccuaccguggagagcaagaucaaaccguucacacugcccauucucaccaucucugaaauguccaacagcagauuuccugugcccaucgacucucugcauacguccccuaccgagaauauugucgugcagugccagaacggacggguuacacuggauggcgagcucauggggaccacacaacugcuucccagccagaucugugcuuuccgcggaacccugacgagaucuacaucccgggcgagcgaccaggccgauaccgcuacaccgcgccucuucaauuauuacuggcacauucagcuggacaaccuuaauggcaccccuuaugaccccgccgaagauaucccugcuccccugggcaccccugacuuuagagggaagguguucggagucgccucccaacggaaccccgauucuacaacgcgcgcccaugaggcgaaaguggacaccacaagcggcagauuuaccccgaagcucgggucccuggaaauuagcacagagucuggagauuucgacccuaaucagcccacccgguuuacgcccguuggcaucgggguggauaacgaagcugacuuccagcaauggucccugccugauuacagcggacaguuuacacacaauaugcaccucgccccggccgucgcucccaacuucccuggcgagcagcugcuguuuuucagaucucagcuucccagcuccggcgggcgcucuaauggaauccucgacugccuggugccucaagaguggguccagcauuuuuaccaggaaagcgcccccgcucagacccaaguggcccuuguucgguaugugaacccugauaccggcagaguccuguucgaggcgaagcuccacaaacugggguuuaugacaauugccaagaacggagacucccccaucaccgugccgccuaauggcuacuuccgcuucgaaagcuggguuaaccccuuuuauacacuggcuccuauggggacgggcaauggacggagacgcauucaguga

SEQ ID NO: 27067 - RNA, 1644 nt, Artificial Sequence
  derived and/or modified sequence opt5 from VP1__Norovirus__AFN06730
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaaccauugugguccaaccgcagaacggcagaugcacacuggaugggacccuucagggaacgacacagcuggugccuacccaaaucuguuccuuucggggcacacucauuagccagaccucucgcuccgccgagagcaccgacucugcucccagaguucggaaucacccucugcaugugcagcuuaagaaccuggaugggacacccuacgacccuacggaugaaguccccgcggugcucggagccaucgacuucaaaggcaccgucuucggcguggcuucccaacgcaauacaaccgggagcuccgccggagccacaagagcucacgagguucacaucgacaccacgaacccgcgguauacaccuaagcugggcucugugcugauguacagcgaguccaccgauuuugacgaugggcagcccaccagauucacacccauuggaaugggcgccgacgauuggcgccagugggaacucccugaguacagcgggcaucugacccuuaauaugaaccuggcgccggcugucgcccccgccuuuccuggagaacggauccucuucuuuagaucugugguucccuccgcuggcggcuaugggagcggacagauugacugccugaucccucaagagugggugcagcacuucuaccaggaagccgcucccucucagagcgccgucgcgcuuauucgcuaugugaauccugauacaggccggaacaucuuugaggccaagcugcauagagagggguucaucacgguggcuaauuccggaaacaaucccauuguugucccgccuaacggcuacuuucgcuucgaagccugggugaaucaauuuuauacccucacacccauggggaccggccagggacggagacgcgugcaguga

SEQ ID NO: 27068 - RNA, 1623 nt, Artificial Sequence
  derived and/or modified sequence opt5 from VP1__Norovirus__AFN06731
augaagauggccagcaacgacgcugcccccuccucugauggcgcggcugggcuggugccugagaucaauaacgaagucaugccgcucgagcccguugccggagccagccuggcuaccccuguggugggccagcaaaauauuaucgaccccuggauuagaaacaauuucguccaggccccugcuggggaauuuacagugucuccccggaacuccccuggagagauccuucuggaucucgaacugggcccggagcuuaaucccuaccuggcccaccucgcgcgcauguauaacgggcaugccggaggcauggagguucagauugugcuggcuggcaaugccuucacggcugggaaaaucaucuuugccgcgauuccucccggauucccuuacgaaaaccugagccccucccagaucaccaugugcccgcacgucauuaucgacgugagacaacucgagccuguucugcuucccaugccugauauucggaauaacuuuuuccauuauaaucagggcaacgaccccaagcugcgccucguggccaugcuguacacaccccuuagagcuaauaacucuggggaugacgucuuuaccgugagcugucgggugcugacaaaaccuuccccggauuucgaauuuaccuuccucguucccccuacagucgagagcaagaccaaacaguuuacgcugcccauccugaagauuucugagaugaccaacucccgcuucccugugcccguggacgucauguauacagccagaaaugaaaaccaggugguucaaccgcagaauggacgggugacccucgauggcgagcugcuugggacaaccccucugcucgcugucaacaucugcaaguuuaaaggagaagugaucgccaagaauggcgacguucgcagcuacagaauggauauggagauuacgaacacagacggcacccccaucgacccuacagaagauacccccgggccuauuggaucucccgacuuccagggcauccuguucgggguggccucccagcggaauaaaaacgagcaaaauccggcuacccgcgcgcacgaggccaacauuaauacaggaggcgaucaguaugcuccuaaacuugcccaggucaaguuuuucagcgaaucucaagacuuugaggugcaucagcccacgaucuucacccccgucgggguggccggagauacaucccacccuuuuagacaguggacccugccgcgguacggcggccaccucacaaacaauacccaucuggcucccgccguugcgccucuguuccccggggaacagcuccuguuuuuccgcagccaaaucccuuccucuggaggccacgagcagggguacauggacugucuugugccccaggaauggguccagcauuuuuaucaagaggcugccacggcccagagcgagguggcucugauuagauucaucaacccugauacaggacggguucucuuugaagccaagcugcacaagcagggcuucauuaccguggcucacaccggggacaaucccaucgucaugccgccuaacggcuacuuuagauucgaggccugggugaaccaguucuauucccuugcgcccgugggaacaggcaaugggcgccggagaguucaauga

SEQ ID NO: 27069 - RNA, 1623 nt, Artificial Sequence
  derived and/or modified sequence opt5 from VP1__Norovirus__AFN06732
augaagauggccagcaacgacgcugcccccuccaaugauggcgcgaccgggcuggugccugagaucaaccacgaaacacucccgcuggagcccgucgcuggagccgccauugcugccccuguuacgggccagaauaacaucauugaccccuggaucagaaccaauuucgugcaagcuccuaacggggaauuuacagugucuccccggaauagcccuggagagauucuucugaaccucgaacugggcccggaucuuaaucccuaccuggcccaucucucccgcauguauaacggguacgcgggaggcgucgaggugcagguucugcuggccggcaaugcuuucaccgccgggaaaauccucuuugcugccgugccucccaacuucccugucgaguuucugucucccgcgcagaucacaaugcuuccgcaccugauuguggacguuagaacccucgaaccuaucaugauuccccugccugaugugcggaauacauucuuucauuauaacaaucagcccgccaaccgcaugagacuugucgcuaugcuguacacgccccuccggagcaacggauccggcgacgauguguucacggugucuugccgcguccugaccagaccuacaccggacuuugaguucaccuaucugguucccccuagcguggaauccaagacaaaacccuuuagccucccuauccugaccauuucugagcuuaccaauucccgguuccccgccccgaucgauagccuguacacagcucaaaacaauaaccucaaugugcagugucagaacgggcgcugcacccuggacggagagcuucagggcacaacccaacugcucccuucugggauuugugccuuuagaggaaagcugaccgccgauguccaccagucccaugacgaucgguggcacaugcagcugacaaaucucaacggcacgcccuucgacccuaccgaagacgugcccgcuccucugggcacacccgauuucaccgggcuucuguuuggaguugcgagccagcgcaauguggucucuaacccgaauacaaccagagcccacgaggcugugaucuccacgacaagcucccaauucguuccuaaacucggcucuaucaacuuugggagcaccuccgacgauuuccagcugcagcaacccaccaaguuuacacccgugggaauuaaggucgaaagcggccaugacuucgaucagugggcccuuccucgguauucugggcaccugacccucaauaugaaccuggccccgcccguggcuccuaauuuucccggagagcagcuccuguucuuucgcuccaacgucccuugcgccggcggcgugagcgacgggguuaucgauugucugcuuccccaggaauggauucaacauuucuaccaggagucugcgccuagccaguccgacguggcucugaucagauacgucaaccccgauacaggacggacgcucuuugaggccaaacugcacagaaccggcuauauuacaguggcccacucuggggacuacccgcugguugugccuagcaauggauauuuccgcuuugauuccugggucaaccaguucuacagccuugcucccaugggcaccgggaauggccggagacgcgugcaauga

SEQ ID NO: 27070 - RNA, 1623 nt, Artificial Sequence
  derived and/or modified sequence opt5 from VP1__Norovirus__AFN06733
augaagauggccagcaacgacgcugcccccuccaaugauggcgcggcugggcuggugccugagucuagcaacgaagccauggcccucgagccggucguuggagcuucccuggccgcucccgugaccggccagacaaauaucauugacccuuggaucagaacgaacuucgugcaagcccccaauggggaauuuaccgucucuccucggaacagccccggagaggugcuuguuaaucuggaacucggcccugagcugaacccguaccuugcgcaccuggccaugauguauaauggguacgcuggaggcauggaggugcagguccuccuggccggcaacgcuuucacagccgggaaaauuaucuuugcggccgugcccccuuauuuccccguugaaaaucuguccccuucucagauuaccauguuuccccaugugaucaucgauguccgcacacucgagccggugcugcuuccuaugcccgacgugagaagcacccuguuccacuuuaaccagaaggaugaaccuaaaaugcggcucgucgcuaugcuguacacaccccuucgcuccaauggaagcggcgacgauguuuucaccgugucuugccggauucugacgagacccuccccugaguuugacuucaccuaucucgugccgcccacagucgagagcaagaccaaaccuuuuacacugcccgugcugacccucggggaacugucuaacucccgcuucccucuuagcaucgaugagaugguuacgucucccaaugaauccauugugguccaaccgcagaacggaagagugacacuggacggcgagcuccuggggaccacacagcuucaggccuguaacaucugcagcauucggggaaagguuaccggccaagugccuaaugaacagcauauguggaaccuggagaucaccaaucucaacggcacacaguuugaucccacggacgaugucccugcuccccugggggugccugacuucgccggagaggucuucggcgugcugucccagcgcaauagaggggaaucuaaccccgccaaucgggcucacgacgcgguuguggccaccuacagcgauaaguauacaccgaaacucggacugguccaaauuggcaccuggaacacaaaugacguggagaaccagccuaccaaguuuacgcccaucgggcuuaaugaaguugcuaacggacaucgcuucgagcaguggacacugcccagauacuccggcgcccucacccugaauaugaaccuugccccugcuguggccccgcuguuucccggcgaacggcuccuguucuuucgcagcuacgucccucugaaagggggauucggcaaucccgcgaucgauugucucgugccucaagagugggugcagcacuuuuaucaggagucugcucccucccugggggacguugcccuugucagauacgugaacccugauaccggacgggugcuguucgaagccaagcuccacaaaggcggguuucugacagucagcucuaccagcacaggccccgugguugugccggcuaacggauauuucagauuugacuccugggucaaucaguucuacucucuggccccuaugggcacggggaacggacgccggagauuucaauga

SEQ ID NO: 27071 - RNA, 1623 nt, Artificial Sequence
  derived and/or modified sequence opt5 from VP1__Norovirus__AFN06734
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacgucccccugaaagaucucuccaauagcagagugccuguucccauucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguuuaucccucuugaaucucccgcgccugucggauuccccgaccugggcgggugugauuggcacgugaauuuuaccuuccaggcccaaaaccaggacccuagccaguccgucaccuuugcuacaaaugaugccagcuucgugcccuaccucggaucuaucuccccgcauaacggcggcgacuuucacagcggggauauuaucggaucucugggcuggauuagcgccccuuccgacucuagccagcugaauguuuggacgauccccaaguauggguccagccuccccgaugugacccaccuggcuccugccgucuucccgcccggauuuggcgaggugauucuuuacuuccauucuacauuuccuggguccggccaacccggacagcugcagguuccuugccuccugccccaggaguucaucacccacuuuuguaacgaacaagcgccuaucgcuggcgaggccgcccuucugcauuauguggaccccgauacagggcggaaucucggagaguucaagcuguacccggacggcuucaugaccugcgucccuaacagcgugucuuccgggccccagacgcugccuauuaauggaguguuuguuuucgucagcugggugucccgcuuuuaucagcucaaacccgugggcacagcuucugccgcuagacggcuggggcuucgcagaaucuga

SEQ ID NO: 27072 - RNA, 1632 nt, Artificial Sequence
  derived and/or modified sequence opt5 from VP1__Norovirus__AFN06735
augaugauggccagcaaggacgcuucccccucugccgauggcgcgaacggggcuggacagcuggugccugaggucaauaacgccgaaccgcucccccuggacccuguugccggcgcuagcaccgcccuugcuacagccgggcaagugaauaugaucgaucccuggaucuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauuaucugcugugucccucccggauuccagagccgcacccuguccaucgcccaggcgacacucuuuccucacauuaucgccgacgugagaacccuggaacccauugagaucccgcuugaagauguucggaacacacuguaucauaccaaugacaaccagccuacgaugcgccuccugugcaugcuuuacacaccccugagaaccggcgggggaucuggcgggaccgaugcuuucguggucgccggacgggugcucacauguccuagcuccgacuuuaauuuccuguuucuggugccucccaccgucgagcaaaagacgcgccccuucagcguuccgaacauuccccuccagcugcuuucuaacuccagagugccuaaucugauccagagcauggugcucucucccgaucaggcucaaaacguccaguuucagaauggccggugcacaaccgacggccaacugcuugggacaaccccuguguccguuagccagauucugaaauuccgcggaaaggugucugccggcuccagagucaucaaccucaccgagcuggaugggagccccuuccuggccuuugaagcuccggcgccuacaggauuccccgaccucggcacguccgacuggcacguggagaugucucugaauagcaacucccagagcucugggaauccuauccuucugcgggauauucagcccaacuccagcgacuuuguuccucaucucggaucugugagcgucaccacagccaucgauguggcuggcgacuauaccggcacaauucaauggaccucccagcccucuaaugucacgccggugccugauguuaacuucuggacaaucccccaguacgggagcaaucuggccgaagccucccagcuugcucccguggucuauccuccgggauuuggcgaggccauuguguacuucaugagccccaucccugggcccaacaccgcgcacaaaccuaaucugguucccugucuccugccucaagaguuugugacccacuucgucucugaacaggcucccuccaugggagaggccgcccuggugcauuauguggacccggauacaaaccgcaaucucggcgaauuuaagcuguacccugagggguucauuaccugcguucccaacggcacaggaccucagcagcuuccccugaacggcgucuuuguguucgcuagcugggugucuagauuuuaccaacucaagccggucgggacggccuccagcgcucggggacgccugggcgugagacgguga

SEQ ID NO: 27073 - RNA, 1635 nt, Artificial Sequence
  derived and/or modified sequence opt5 from VP1__Norovirus__AFN06736
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcgggaauggaaucaaccugacagagcuuaauggcgaaccuuaucacgccuucgagucccccgccccgauuggguucccugaucugggaggcugcgacuggcaucucaccgcuacacccacccaggcguuuaacgacggggccaagguggucagacugucugugacgcagggagcugccuucgccccucaccuuggcacaauccacuacaccaccacagaucaugacuaugaucccaauaccagcaucauuuguacacuggacuggcucucccagacgaccggccaaaacaauguugauccuuggcagauccccacauacgggagcacccugacagaagcugcccagcuggcgccgccuauuuuuccucccggauucggcgagacccucguguuuuuccugucugacuuucccaucuccaacgggaagaauggacuuagcgucccgugcacgcugccccaggaguucgugacccacuuugucaacgaacaagcuccuauucggggcgaggccgcccuccugcauuauguggaucccgacacacaccgcaaucuuggggaguucaaacuguacccugaaggcuuuaugaccuguguucccaacacaucuggaggcgggccucagacccuccccaucaacggaguguucgucuuugugagcuggguuuccagauucuaccagcugaagccggugggcacggcuggggccgcucggcgccugggaaucagacggucuuga

SEQ ID NO: 27074 - RNA, 1635 nt, Artificial Sequence
  derived and/or modified sequence opt5 from VP1__Norovirus__AFN06738
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcgagccagaauaucuccauugcccaggcuacaauguuuccccacguuaucgccgaugugagaguccucgaaccuauugaagugccccuggaggacguucggaacgugcuguuccauaauaacgauaauaccccgacgaugcgccucgucuguaugcuguacaccccucuuagagcuucuggcagcuccagcgggacagaccccuuugugaucgccggacgggugcugaccugcccuucucccgauuucuccuuucucuuccugguucccccuaacgucgagcagaagacaaaaccguuuagcgugcccaaccuuccucugaaugugcucucuaacucccgcguccccagccugauuaaguucaugauggugucucaagaccacggccagaugguucaguuucagaaugggagagugacccuggauggacaacuccagggcacgacaccuaccuccgccagccagcuguguaagaugcggggcacagucuaucaugcuuccgggggacaaggccuuaaccugaccgaaaucgacgggacccccuaccacgcguucgagucuccggccccuaucggauuccccgaucucggcgacagcgacuggcacauuaaugcuuccccugccacaacguuuaacaccggggaaagcgugaaacgccuggauauggagcagggaucuuccuucgcuccccaucuuggcacaguucacuauaccaaugccgacuacgaugccaacacagaccugaucugcagccucgaguggcugucuccucccagcggcgggaccccgaauaaggugaacccuugggcgauucccagauauggauccacgcugacagaagcugcccagcucgcucccccuaucuacccgcccggcuuuggggaggccauugucuucuuuaugucugauuucccuaucgccaauggacaggacggccugaaagugcccuguaccaucccucaagaauuugucacccauuucgugaacgagcaggcucccacacgcggggaagccgcgcuucugcacuacguugauccugacacccaccggaaucucggcgaguuuaagcuguaucccgagggauucaugacaugcgugccgaacagcuccggcagcgggccucagacgcuucccauuaauggagucuuuaccuucgugucuuggguuuccagauuuuaccagcugaaaccugugggcacaaccgggcccguccggcgccucggaaucagacggagcuga

SEQ ID NO: 27075 - RNA, 1635 nt, Artificial Sequence
  derived and/or modified sequence opt5 from VP1__Norovirus__AFN06739
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcgagccagaauaucuccauugcccaggcuacaauguuuccccacguuaucgccgaugugagaguccucgaaccuauugaagugccccuggaggacguucggaacgugcuguuccauaauaacgauaauaccccgacgaugcgccucgucuguaugcuguacaccccucuuagagcuucuggcagcuccagcgggacagaccccuuugugaucgccggacgggugcugaccugcccuucucccgauuucuccuuucucuuccugguucccccuaacgucgagcagaagacaaaaccguuuagcgugcccaaccuuccucugaaugugcucucuaacucccgcguccccagccugauuaagucuaugauggugucccaagaccacggccagaugguucaguuccagaaugggagagugacccuggauggacaacuccagggcacgacaccuaccagcgccucccagcuguguaagaugcggggcacagucuaucaugcuucugggggacaaggccuuaaccugaccgaaaucgacgggacccccuaccacgcguuugagagcccggccccuaucggauuccccgauauuggcgacuccgacuggcacaucaaugcuagcccugccacaacguucgauucuggggaauccauuaaacgccucgacauggagcagggaagcucuuuugcuccccaucugggcaccgugcacuauacaaacgccgauuacccugccaauaccgaccuuaucugcagccuggaguggcucucucccccguccggcgggacaccuaacaagguuaaucccuggaccauucccagauauggaagcacgcugacagaagcggcucagcuggccccuccgaucuaucccccuggcuucggggaggccaucguguuuuucauguccgauuuucccauugcuaacggacaggacggccucaaagucccuuguaccaucccccaagaguucgugacccauuuugucaaugaacaggccccuacacgcggggaagcugcccugcuucacuacguggaucccgacacccaccggaaccugggcgaguucaagcucuacccggagggauuuaugacaugcguuccuaauagcucuggcuccgggccccagacgcugccuauuaacggaguguucaccuuugucagcugggugucuagauucuaccagcuuaaacccguuggcacaaccgggccggugcggcgccugggaaucagacgguccuga

SEQ ID NO: 27076 - RNA, 1623 nt, Artificial Sequence
  derived and/or modified sequence opt5 from VP1__Norovirus__AFV08771
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccauccugacgguggaggaaaugaccaacagcagauuuccuauuccccuugagaagcuguucacagggccgucuuccaccuucgucgugcagccucagaauggacgguguacaaccgauggcguucuccuggggacgacacaacugagccccgugaacaucugcaccuuucgcggagacgucacacauaucgccggcucuagaaauuacaccaugaaccucgcuucccagaauuggaacagcuaugauccuaccgaggaaauucccgcgccucugggcacacccgacuucguggggaaaauccagggaguccuuacgcagaccacacggaccgacggcuccacacgcgggcacaaggccaccguguacacgggaucugcugauuuuagcccgaagcugggcagaguucaauucgccacagacaccgauaaugacuuugaugccaaccagaauaccaaauucacaccugugggggucauucaggacggaaacaccgcucaucggaaugagccccaacagugggugcuccccuccuacagcggccgcaacacacacaauguucaccuggccccugcgguggcuccgacguuucccggcgaacagcuucuguucuuuagaucuaccaugccuggguguuccggauaucccaacauggaucucgacugccugcugccucaggaguggguccaauacuucuaucaggaagccgcccccgcucagagcgauguggcccuccugcgguuugugaacccugacacaggcagaguucuuuucgaguguaagcugcauaaaucuggguacgucaccguggcucacacaggacagcaugaucucgugauucccccgaauggcuauuuucgcuucgacagcugggucaaccaauucuacacccuggccccuauggggaauggcacgggacggagacgcgcgcuuuga

SEQ ID NO: 27077 - RNA, 1623 nt, Artificial Sequence; identical to SEQ ID NO: 26674
  derived and/or modified sequence opt5 from VP1__Norovirus__AFV08774

SEQ ID NO: 27078 - RNA, 1623 nt, Artificial Sequence
  derived and/or modified sequence opt5 from VP1__Norovirus__AFV08777
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccucuuuuccuaucgagggacugagccccucccaggugaccauguucccgcauauuaucgucgacgugagacaacucgagccugugcugauuccccugccugauguccggaacaauuuuuaucacuacaaccagagcaaugaccccacaaucaagcucauugcuaugcuguauacaccccuucgcgccaacaaugcuggcgaugacguuuucaccgugucuugcagagugcugacccggccuuccccggauuuugacuucaucuuucucgugcccccuacagucgaaagccgcaccaaacccuucucuguuccugugcugacggucgaggaaaugaccaacuccagauuucccauuccgcuugagaagcuguucacagggccuagcucugccuucgugguucagccccagaacggacgguguaccacagauggcgugcuccuggggaccacgcaacuguccccugucaauaucugcacauuucgcggaaacgugacccauaucagcggcuccagaaauuacacaaugaaccucgccucucagaauuggaacagcuaugaccccaccgaggaaauuccugcuccccugggcaccccggauuucgucgggaaaauccagggagugcuuacacagacgaccaagacaaauggcuccacccgggggcacaaggcgacaguuuacaccggaagcgccgacuuuucuccuaaacugggccgcgugcaauucgcuacggacacagauaacgacuuugagaccaaucagaacaccaaguucacacccgucggggugauucaggauggauccaccacacccagaaaugaaccucaacaguggguucucccgagcuacucuggccggaacacgcauaaugugcaccuggcccccgccgucgcuccuaccuuucccggcgagcagcuucuguucuuucgcagcacaaugccuggguguuccggauaucccaacauggaccucgauugccugcugccucaggaaugggugcaauacuucuaucaggaggccgcgcccgcucagucugacguggcccuccugagauuuguuaauccggauaccggccggguccuuuucgaguguaaacugcacaagagcggguacgugacaguggcccauaccggacagcacgaccucgucaucccucccaacggcuauuuuagauucgauuccugggugaaccaauucuacacgcuggcuccuauggggaauggcaccggacgccggagagcccuuuga

SEQ ID NO: 27079 - RNA, 1623 nt, Artificial Sequence
  derived and/or modified sequence opt5 from VP1__Norovirus__AFV08780
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgaucaugacuuugaugcuaaucagaauacaaaauucacccccgugggggucauucaggacggagauacagcccaccggaacgagccccaacagugggugcucccuucuuacagcggccgcaauucccacaacguucaucuggcgccgacgguggcucccaccuuuccuggcgaacagcuucuguucuuuagaagcacaaugcccggguguucuggauauccuaauauggaccucgauugccugcugccccaggaguggguccaauacuucuaucaggaagccgccccugcucaguccgacguggcccuccugcgguuugugaaccccgauaccggcagaguucuuuucgaguguaagcugcacaaaagcggguacgucacaguggcucauaccggacagcacgaccucgugaucccgccuaauggcuauuuucgcuucgacucuugggucaaccaauucuacacgcuggcccccauggggaacggcaccggacggagacgcgcgcuuuga

SEQ ID NO: 27080 - RNA, 1623 nt, Artificial Sequence
  derived and/or modified sequence opt5 from VP1__Norovirus__AFV08783
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggaaugcuuacgcagaccacacggaccgacggcucuacacgcgggcacaaggcgaccguguacacgggaagcgccgauuuuuccccuaagcugggcagaguucaauucgcuacagacaccgauaaugacuuugugaccaaucagaacacaaaauucacccccgucggggugauccaggauggaagcacaacgccccggaaugagccucaacaguggguucucccgucuuacuccggccgcaacacccauaaugugcaccuggcccccgccgucgcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguggcccuccugcgguuuguuaauccggauacaggcagaguccuuuucgaguguaagcugcacaaaaccggguacgugacgguggcccauaccggacagcacgaccucgucauuccucccaacggcuauuuucgcuucgauuccugggugaaccaauucuacacacuggcuccuauggggaauggcaccggacggagacgcgcccuuuga

SEQ ID NO: 27081 - RNA, 1623 nt, Artificial Sequence
  derived and/or modified sequence opt5 from VP1__Norovirus__AFV08786
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccucccaacggcuacuuucgguucgacucuugggugaaucaguucuauacgcuugccccuaugggaaacggcaccgggagacgccgggcucuguga

SEQ ID NO: 27082 - RNA, 1623 nt, Artificial Sequence
  derived and/or modified sequence opt5 from VP1__Norovirus__AFV08789
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucggaacagacaccgaaaacgauuuugagacccaucaaaauacaaaguucacccccgugggcgucauucaggacggcgggacaacgcaccgcaacgaaccccagcaaugggugcugccuucuuacagcggaagagauguuccgaaugugcaccuugcccccgcugucgccccuaccuuucccggcgagcagcuccuguucuuucgguccacaaugccuggguguagcggauaucccaacauggaccuggauugccugcucccucaggagugggugcagcauuucuaccaagaagcggcucccgcccagucugacguggcccugcuucgcuuuguuaauccggauaccggcagaguccuguucgaguguaaacuccacaaguccggguaugugacaguggcucauaccggccagcacgaccuggucaucccucccaacggauacuuucgguucgauagcugggugaaccaguucuauacgcuugccccuaugggcaaugggaccggaagacgccgggcucuguga

SEQ ID NO: 27083 - RNA, 1623 nt, Artificial Sequence
  derived and/or modified sequence opt5 from VP1__Norovirus__AFV08792
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgacgagauucccgcgccucugggcacacccgacuucguugggaaaauccagggaaugcuuacgcagaccacacggaccgauggcuccacacgcgggcacaaggccaccguguacacgggaucugcugacuuugccccgaagcugggcagaguccaauucgaaacagauaccgaccaugauuuugaggccaaucagaacaccaaauucacaccuguggggguuauccaggacggaagcaccacacaccggaaugaaccccaacagugggugcuccccuccuacagcggccgcaacacgcacaauguccaucuggcuccugccguggcgccgaccuuucccggcgagcagcuucuguucuuuagaucuacaaugccuggguguuccggauaucccaacauggaucucgacugccugcugccucaggaaugggugcaauacuucuaucaggaggcugcccccgcccagagcgauguugcucuccugcgguuugucaauccugacaccggcagagugcuuuucgaguguaagcugcacaaaucuggguacgugacagucgcccauaccggacagcacgaucucgugauucccccgaacggcuauuuucgcuucgacagcuggguuaaccaauucuacacgcuggcuccuauggggaauggcaccggacggagacgcguggucuga

SEQ ID NO: 27084 - RNA, 1623 nt, Artificial Sequence
  derived and/or modified sequence opt5 from VP1__Norovirus__AFV08795
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaaugauuaugaccccaccgaggaaauuccugcgccccugggcacaccggacuucguugggaaaauccagggagugcuuacgcagaccacacggaccgauggcagcacacgcgggcacaaggccaccgucuacacgggauccgcugacuuugccccuaagcugggcagagugcaauucgagacagauaccgaccgggauuuugaagccaaccagaauaccaaauucacacccguuggggugauccaggacggaggcaccacacaucgcaacgagccccaacaguggguccucccuucuuacagcggcagaaauacgcacaacgugcaccuggcuccggccguggcgcccaccuuuccuggggaacagcuucuguucuuucgguccacaaugcccggauguagcggcuauccuaauauggaucucgacugccugcugccccaggaguggguucaauacuucuaucaggaggcugccccugcccagucugaugucgcucuccugagauuugugaaccccgacaccgggcgcgugcuuuucgaauguaagcugcauaaauccggauacgucacaguggcccacaccggccagcaugaucucguuauuccgccuaauggguauuuucgguucgacagcugggugaaccaauucuacacgcuggcucccaugggcaacggaaccggcagacgccgggccgucuga

SEQ ID NO: 27085 - RNA, 1623 nt, Artificial Sequence
  derived and/or modified sequence opt5 from VP1__Norovirus__AFX95940
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaagcaccacacaucgcaacgagccccaacaguggguccucccuuccuacagcggcagaaauacgccgaacgugcaccuggcucccgccguggcgccuaccuuucccggcgaacagcuucuguucuuucggucuacaaugccuggguguuccggauaucccaauauggaccucgauugccugcugccucaggaguggguucaauacuucuaucaggaggcugcccccgcccagagcgacgucgcucuccugagauuugugaacccggauaccggccgcgugcuuuucgaauguaagcugcacaaaucuggguacgucacaguggcccauaccggacagcacgaccucguuauuccucccaauggcuauuuucgguucgauagcugggugaaccaauucuacacgcuggcuccuauggggaacggcaccggaagacgccgggcccuuuga

SEQ ID NO: 27086 - RNA, 1620 nt, Artificial Sequence
  derived and/or modified sequence opt5 from VP1__Norovirus__AFZ84663
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacgucacacauaucgcuggcucccacgauuauaccaugaaccucgcgagccagaauuggaacaauuacgaccccaccgaggaaauuccugcuccccugggcacaccugacuuuguggggaaaauccagggaaugcuuacgcagaccacaagagaggauggcuccacccgggcccauaaggccacagucucuaccgggagcgugcacuucacgcccaagcugggauccguucaauacacaaccgacaccaacaaugauuuucagacaggccagaacaccaaauucacaccggugggggucauucaagacggaaauaaccaccagaaugaaccucagcagugggugcuccccaacuauagcggccgcacgggccauaauguucaccuggcccccgcuguggccccuaccuuuccgggggagcaacuucuguucuuuagaucuacaaugcccggauguuccggcuacccuaacaugaaccucgauugccugcugccccaggaauggguccagcauuucuaucaggaggcggcuccugcccaaagcgacguggcccuccugcgguuugugaaucccgauaccgggcgcguucuuuucgaguguaagcugcacaaaucuggauacgucacaguggcucacaccggcccucaugaccucgugauucccccgaacggguauuuuagauucgauagcugggucaaucaguuuuacacgcuggccccuaugggcaacggagcuggccggagacgcgugcuuuga

SEQ ID NO: 27087 - RNA, 1623 nt, Artificial Sequence
  derived and/or modified sequence opt5 from VP1__Norovirus__AGG37871
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugaagucgcucuccugcgguuugugaaucccgacaccgggagagugcuuuucgaguguaagcugcacaaauccggauacgucacaguggcccauaccggccaguaugaucucguuauuccgccuaacggguacuuucgcuucgacagcugggugaaccaauucuauacgcuggcucccaugggcaauggaaccggccggagacgcgccgucuga

SEQ ID NO: 27088 - RNA, 1623 nt, Artificial Sequence
  derived and/or modified sequence opt5 from VP1__Norovirus__AGI96383
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucucuacagauaccaauaacgacuuugagaccaaucagaacacaaaauucacccccgugggggucauucaggauggauccacaacgccccgcaaugaaccucaacagugggugcucccgagcuacucuggcagaaacauccacaauguucaccuggcucccgccguggccccuaccuuucccggcgagcagcuucuguucuuucggagcacaaugccuggguguuccggauaucccaacauggaccucgauugccugcugccucaggaauggguccaauacuucuaucaggaggcugcccccgcgcagucugacguggcucuccugcgcuuugugaacccggauaccggcagaguucuuuucgaguguaagcugcauaaaagcggguacgucacaguggcccacaccggacagcaugaccucgugauuccucccaauggcuauuuucgguucgauuccugggucaaccaauucuacacgcuggccccuauggggaauggcaccggaagacgccgggcucuuuga

SEQ ID NO: 27089 - RNA, 1623 nt, Artificial Sequence
  derived and/or modified sequence opt5 from VP1__Norovirus__AGI99552
augaagauggccagcuccgacgcuaaccccucugauggcagcgccgcgaaucuggugccuaaagucaacaaugagguuauggcucucgaaccgguggugggggccgccaucgcugcccccgucgcuggacagcaaaacgugauugacccuuggaucaagaauaacuucguucaggcccccggcggggaguuuaccguguccccuaaaaaugcgcccggagaaauucuguggucugccccucuuggcccggaucugaaccccuaccucagccaccuggcuaagauguauaauggguacgccggaggcuucgagguccaggugauccuugcuggcaacgccuuuacagcggggaaaguuauuuucgccgcugugccucccaauuuuccuacggaaggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggagucucgcaccaagcccuucuccgucccugugcugacgguugaagagaugaccaauagcagauuucccaucccgcuugaaaaacuguucacagggccuucuuccgccuucgugguccagccccagaacggacgguguaccacagauggcgugcuccuggggaccacgcaacugagcccugucaauauuugcacauuucgcggagacgugacccauacaaucggcucuagaaacuacaccaugaaucucgcuucccagaacuggaauaacuaugaucccaccgaggagauuccugcgccccugggcacaccggacuucguugggaagauccagggagugcuuacgcagaccacacggaccgacggcagcacacgcgggcacaaagccaccgucuacacgggauccgcugauuuugccccuaagcugggcagagugcaauucgaaacagacaccgaucaugacuuugaggccaaucagaacaccaaauucacacccguuggggugauccaggauggaucuaccacacaccggaaugaaccccaacaguggguccucccuagcuacuccggccgcaacacgcacaaugugcaucuggcuccggccguggcgcccaccuuuccuggcgagcagcuucuguucuuuagaagcacaaugcccggguguucuggauauccuaacauggaccucgauugccugcugccccaggaauggguucaauacuucuaucaggaggcugccccugcccaguccgacgucgcucuccugcgguuugugaaucccgauaccggccgcgugcuuuucgaguguaagcugcacaagagcggguacgucacaguggcccauaccggacagcacgaccucguuauuccgccuaacggcuauuuuagauucgauucuugggugaaccaauucuacacgcuggcucccauggggaauggcaccggacggagacgcccucuuuga

SEQ ID NO: 27090 - RNA, 1623 nt, Artificial Sequence
  derived and/or modified sequence opt5 from VP1__Norovirus__AGI99553
augaagauggccagcuccgacgcuaaucccccugauggcucugccgcgaaccuggugccgaaagucaacaaugagguuauggcucucgaacccguggugggggccgccaucgcugccccugucgcuggacagcaaaacgugauugaccccuggaucaagaauaacuucguucaggccccuggcggggaguuuaccgugagccccaaaaaugcgccuggagaaauucugugguccgccccgcuuggccccgaucugaacccuuaccucucucaccuggcuagaauguauaauggguacgccggaggcuucgagguccaggugauccuugcuggcaacgccuuuacagcggggaagguuauuuucgccgcugugcccccuaauuuucccacggaaggacugagcccgucccaggucaccauguucccucauaucgugguggacguccggcaacucgagcccguucugaucccucugcccgaugugcgcaacaauuuuuaucacuacaaccagucuaaugaccccacaauuaaacucaucgccaugcuguauaccccucuuagagcuaacaacgccggcgaugacguguucacagucagcugccgggugcugacccgcccgucccccgauuuugacuucauuuuucucguuccucccacaguggagagcagaaccaagccuuucucuguccccgugcugacgguugaagagaugaccaauucccgguuuccgaucccucuugaaaagcuguucacagggcccagcucugccuucgugguccagccucagaacggacgcuguaccacagauggcgugcuccuggggaccacgcaacugucccccgucaauauuugcacauuuagaggagacgugacccauaucacaggcagccggaacuacaccaugaaucucgcuucucagaacuggaauaacuaugauccuaccgaggagauucccgcgccgcugggcacaccugacuucguugggaaaauccagggagugcuuacgcagaccacacgcaccgacggcuccacaagagggcacaaggccaccgucuacacgggaagcgcugauuuugcccccaaacugggccgggugcaauucgaaacagacaccgaucaugacuuugaggccaaucagaacaccaaguucacacccguuggggugauccaggauggauccaccacacaccgcaaugaaccucaacaguggguccucccgucuuacagcggcagagacacgcacaacgugcaucuggcucccgccguggcgccuaccuuucccggcgagcagcuucuguucuuucgguccacaaugccuggguguagcggauaucccaauauggaucucgacugccugcugccucaggaauggguucaauacuucuaucaggaggcugcccccgcccagucugaugucgcucuccugcgcuuugugaacccggacaccggcagagugcuuuucgaguguaaacugcacaaguccggguacgucacaguggcccauaccggacagcacgaucucguuauuccucccaauggcuauuuucgguucgacagcugggugaaccaauucuacacgcuggcuccuauggggaacggcaccggaagacgccggccccuuuga

SEQ ID NO: 27091 - RNA, 1623 nt, Artificial Sequence
  derived and/or modified sequence opt5 from VP1__Norovirus__AGI99554
augaagauggccagcuccgacgcuaaccccucugauggcagcgccgcgaaucuggugccuaaagucaacaaugagguuauggcucucgaaccgguggugggggccgccaucgcugcccccgucgcuggacagcaaaacgugauugacccuuggaucaagaauaacuucguucaggcccccggcggggaguuuaccguguccccuaaaaaugcgcccggagaaauucuguggucugccccucuuggcccggaucugaaccccuaccucagccaccuggcuagaauguauaauggguacgccggaggcuucgagguccaggugauccuugcuggcaacgccuuuacagcggggaagguuauuuucgccgcugugccucccaauuuuccuacggaaggacugucccccucucaggucaccauguucccgcauaucgugguggacguccggcaacucgagccuguucugaucccccugccugaugugcgcaacaauuuuuaucacuacaaccagagcaaugaccccacaauuaaacucaucgccaugcuguauacaccccuuagagcuaacaacgccggcgaugacguguucaccgucuccugccgggugcugacccgcccuagcccggauuuugacuucauuuuucucguucccccuacaguggagucuagaaccaagcccuucuccgucccugugcugacgguugaagagaugaccaauagccgguuucccaucccgcuugaaaagcuguucacagggccuucuuccgccuucgugguccagccccagaacggacgcuguaccacagauggcgugcuccuggggaccacgcaacugagcccugucaauauuugcacauuuagaggagacgugacccauaucacaggcucucggaacuacaccaugaaucucgcuucccagaacuggagcaauuaugaucccaccgaggagauuccugcgccccugggcacaccggacuucguugggaaaauccagggagugcuuacgcagaccacacgcaccgacggcuccacaagagggcacaaggccaccgucuacacgggaucugcugauuuugccccuaaacugggccgggugcaauucgaaacagacaccgaucgcgacuuugaggccaaccagaauaccaaguucacacccguuggggugauccaggauggaagcaccacacauagaaacgaaccccaacaguggguccucccuuccuacagcggccggaauacgccgaacgugcaccuggcucccgccguggcgccuaccuuucccggcgagcagcuucuguucuuucgcucuacaaugccuggguguuccggauaucccaauauggaccucgauugccugcugccucaggaauggguucaauacuucuaucaggaggcugcccccgcccagagcgacgucgcucuccugagauuugugaacccggauaccggccgggugcuuuucgaguguaaacugcacaagucuggguacgucacaguggcccauaccggacagcacgaccucguuauuccucccaauggcuauuuuagauucgauagcugggugaaccaauucuacacgcuggcuccuauggggaacggcaccggacgccggagaccccuuuga

SEQ ID NO: 27092 - RNA, 1623 nt, Artificial Sequence
  derived and/or modified sequence opt5 from VP1__Norovirus__AGI99555
augaagauggccagcuccgacgcuaaccccucugauggcagcgccgcgaaucuggugccuaaagucaacaaugagguuauggcucucgaaccgguggugggggccgccaucgcugcccccgucgcuggacagcaaaacgugauugacccuuggaucaagaauaacuucguucaggcccccggcggggaguuuaccguguccccuaaaaaugcgcccggagaaauucuguggucugccccucuuggcccggaucugaaccccuaccucagccaccuggcuagaauguauaauggguacgccggaggcuucgagguccaggugauccuugcuggcaacgccuuuacagcggggaagguuauuuucgccgcugugccucccaauuuuccuacggaaggacugucccccucucaggucaccauguucccgcauaucgugguggacguccggcaacucgagccuguucugaucccccugccugaugugcgcaacaauuuuuaucacuacaaccagagcaaugaccccacaauuaaacucaucgccaugcuguauacaccccuuagagcuaacaacgccggcgaugacguguucaccgucuccugccgggugcugacccgcccuagcccggauuuugacuucauuuuucucguucccccuacaguggagucuagaaccaagcccuucuccgucccugugcugacgguugaagagaugaccaauagccgguuucccaucccgcuugaaaagcuguucacagggccuucuuccgccuucgugguccagccccagaacggacgcuguaccacagauggcgugcuccuggggaccacgcaacugagcccugucaauauuugcacauuuagaggagacgugacccauaucacaggcucucggaacuacaccaugaaucucgcuucccagaacuggaauaacuaugaucccaccgaggagauuccugcgccccugggcacaccggacuucguugggaaaauccagggagugcuuacgcagaccacacgcaccgacggcagcacaagagggcacaaggccaccgucuacacgggauccgcugauuuugccccuaaacugggccgggugcaauucgaaacagacaccgaucaugacuuugaggccaaucagaacaccaaguucacacccguuggggugauccaggauggaggcaccacacaccgcaaugaaccccaacaguggguccucccuucuuacagcggcagaaacacgcacaaugugcaucuggcuccggccguggcgcccaccuuuccuggggagcagcuucuguucuuucgguccacaaugcccggauguagcggcuauccuaacauggaccucgauugccugcugccccaggaauggguucaauacuucuaucaggaggcugccccugcccagucugacgucgcucuccugcgcuuugugaaucccgauaccgggagagugcuuuucgaguguaaacugcacaaguccggauacgucacaguggcccauaccggccagcacgaccucguuauuccgccuaacggguauuuucgguucgauagcugggugaaccaauucuacacgcuggcucccaugggcaauggaaccggcagacgccggccucuuuga

SEQ ID NO: 27093 - RNA, 1623 nt, Artificial Sequence
  derived and/or modified sequence opt5 from VP1__Norovirus__AGK25882
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacggcucgagccugugcugaucccccugccugauguccgcaacaauuuuuaucacuacaaccaaagcaaugacuccacaauuaagcucaucgccaugcuguauacaccccuuagagcuaacaacgccggcgaagauguuuucaccgugagcugccgggugcugacccgccccucuccugacuuugauuucauuuuucucgucccgcccacaguggaguccagaaccaaaccuuucacgguucccauccugaccguggaagagaugacauacagccgguuuccuauuccccuugagaagcuguucaccgggccgucuuccgccuucgucgugcagccucagaauggacgcuguacaaccgacggcguucuccuggggacgacacagcugagccccgugaacaucugcaccuuuagaggagaugucacacauaucgcuggcucucggaauuauaccaugaaccucgcgucccugaauuggaacaauuacgacccuaccgaagagauucccgccccucuuggcacacccgauuucguggggaaaauccaaggaaugcugacgcagaccacaaagggcgacgggagcacccgcggacacaaggcuacagucuacaccggcuccgccccguuuacgccuaaacucgggucugugcaguucgaaacagacaccgagaacgauuuugaaacccaucagaauauuaaguucacacccguuggagugauccaagacggcggcaccacacacagaaacgagccccagcaguggguccugccuagcuauuccgggcggaaugugccgaacguucaccuugcccccgcuguggccccuacguuucccggagagcaacuccuguucuuucgcagcaccaugccuggcuguucuggguaccccaauauggaucuggacugccugcucccucaggaauggguccagcauuucuaucaggaggcggcucccgcccaauccgauguggcccugcuuagauuugugaacccggacacaggacggguucuguucgaauguaaacuccacaagagcggcuacgucaccguggcucauacagggcagcacgaucugauuaucccucccaauggcuauuuuagauucgacucuugggugaaccaguucuacacccuugccccuaugggaaacggcacggggcgccggagagcucuguga

SEQ ID NO: 27094 - RNA, 1623 nt, Artificial Sequence
  derived and/or modified sequence opt5 from VP1__Norovirus__AGK25884
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccgcuaagggcgacgggagcacacggggacacaaggccaccgucuacacaggcuccgccccguuuaccccuaaacucgggucugugcaguucgaaacggacacagagaaugauuuugaaacccaucaaaacaccaaguucacacccguuggagugauucaggacggcggcaccacacaccgcaaugagccccagcaauggguccugccuagcuacuccgggagaaacgugccgaauguucaccuugcucccgccguggcgccuacguuucccggagagcagcuccuguucuuucggagcaccaugccuggcuguucugggugccccgauauggaccuggauugucugcucccucaggaauggguccagcauuucuaucaagaggcugcccccgcccaguccgacguggcucugcuucgcuuugugaacccggauacaggaagaguucuguucgaaugcaaacuccacaagagcggcuacgucaccguggcccauacagggcagcacgaccugaucauuccucccaauggcuauuuucgguucgauucuugggugaaccaguucuacacccuugcuccuaugggaaacggcacggggagacgccgggcccuguga

SEQ ID NO: 27095 - RNA, 1623 nt, Artificial Sequence
  derived and/or modified sequence opt5 from VP1__Norovirus__AGK25887
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacaucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccgugcauacgggauccgcugauuuugccccuaagcugggcagaguccaauucgagacagacaccgaucacgacuuugaagccaaucagaacaccaaauucacacccguggggguuauucaggauggaggcaccacacaccggaaugagccccaacagugggugcucccuucuuacagcggccgcaacacgcauaauguccaccuggcuccggccguggcgcccaccuuuccuggggaacagcuucuguucuuuagauccacaaugcccggauguagcggcuacccuaacauggaccucgauugccugcugccccaggagugggugcaauauuucuaccaggaggcugccccugcccagucugacguugcucuccugcgguuugucaaucccgauaccgggagagugcuuuucgaauguaagcugcauaaauccggauaugugacagucgcccacaccggccagcacgaccucgugaucccgccuaacggguacuuucgcuucgauagcuggguuaaccaauucuauacgcuggcucccaugggcaauggaaccggccggagacgcgccguguga

SEQ ID NO: 27096 - RNA, 1623 nt, Artificial Sequence
  derived and/or modified sequence opt5 from VP1__Norovirus__AGK25890
augaagauggccagcuccgacgcuaaccccucugauggcagcgccgcgaaucuggugccugaggucaacaaugaaguuaucgcucucgagccgguggugggggccgccauugcugcccccgucgcuggacagcaaaacgugaucgacccuuggauuagaaauaacuucguucaggcccccggcggggaauuuaccguguccccucggaaugcgcccggagagauccuguggucugccccucuuggcccggaucugaaccccuaccucagccaccuggcucgcauguauaauggguacgccggaggcuucgaaguccaggugauucuugcuggcaacgccuuuacagcggggaaaguuaucuucgccgcugugccucccaauuuuccuacggagggacugucccccucucaggucaccauguucccgcauaucgugguggacgucagacaacucgagccuguucugauuccccugccugaugugcggaacaauuuuuaucacuacaaccagagcaaugaccccacaaucaagcucauugccaugcuguauacaccccuucgcgcuaacaacgccggcgaugacguguucaccgucuccugcagagugcugacccggccuagcccggauuuugacuucaucuuucucguucccccuacaguggaaucucgcaccaaacccuucuccgucccugugcugacgguugaggaaaugaccaauagcagauuucccauuccgcuugagaagcuguucacagggccuucuuccgccuucgugguccagccccagaacggacgguguaccacagauggcgugcuccuggggaccacgcaacugagcccugucaauaucugcacauuucgcggagacauugcucauaucaccggcucuagaaacuacacaaugaaucucgcgucccagaacuggaauaacuaugaucccaccgaggaaaucccugcuccccugggcaccccggacuucguggggaaaauucagggaguucuuacacagacgacccggacagacggcagcacccgcgggcacaaggccacaguguacaccggauccgccgauuuugccccuaagcugggcagaguccaauucgagacggacacagaucaugacuuugaagcuaaucagaacaccaaauucacccccguggggguuauccaggauggaggcacaacccaccggaaugagccccaacagugggugcucccuucuuacagcggccgcaacacacacaauguccaucuggccccggcgguggcucccacguuuccuggggaacagcuucuguucuuuagauccaccaugcccggauguagcggcuauccuaacauggaccucgauugccugcugccccaggagugggugcaauacuucuaucaggaggccgccccugcucagucugacguugcccuccugcgguuugucaaucccgauacagggagagugcuuuucgaauguaaccugcacaaguccggauacgugaccgucgcucauacaggccagcacgaccucgugauuccgccuaacggguauuuucgcuucgauagcuggguuaaucaauucuacacccuggcccccaugggcaacggaacgggccggagacgcgcgguguga

SEQ ID NO: 27097 - RNA, 1623 nt, Artificial Sequence; identical to SEQ ID NO: 26482
  derived and/or modified sequence opt5 from VP1__Norovirus__AGK25892

SEQ ID NO: 27098 - RNA, 1623 nt, Artificial Sequence
  derived and/or modified sequence opt5 from VP1__Norovirus__AGK25898
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggauacgacacaacugucccccgugaacaucugcaccuuucgcggggacgucacacauaucgcuggaagcagaaauuacaccaugaaccucgcgucucugaauuggaacaauuaugauccuaccgaagagauucccgccccucuuggcacacccgacuucgugggcaaaauccaggggaugcugacgcagaccacaaagggagacggcuccacccgggggcacaaggcuacagucuacaccggaagcgccccguuuacgccuaaacucggcuccgugcaguucgaaacagauaccgagaacgacuuugaaacccaucaaaauacaaaguucacccccguuggggugauucaggauggaggcacaacgcaccgcaacgagccccagcaauggguccugccuucuuacagcggcagaaaugugccgaacgcccaccuugcucccgccguugcgccuaccuuucccggggagcagcuccuguucuuucgguccacaaugccuggauguagcggcuaucccaauauggaccuggauugccugcucccucaggaaugggugcagcauuucuaccaagaggcugcccccgcccagucugacgucgcucugcuucgcuuugugaacccggauaccgggagagugcuguucgaauguaaacuccacaaguccggauauguuacagccgcucauaccggccagcacgaccuggucaucccucccaacggguacuuucgguucgauagcugggugaaucaguucuauacgcuugccccuaugggcaacggaaccggcagacgccgggcgcuguga

SEQ ID NO: 27099 - RNA, 1623 nt, Artificial Sequence
  derived and/or modified sequence opt5 from VP1__Norovirus__AGK25900
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaacucugcgucccucaauuggaacaauuaugacccuaccgaagagauucccgccccucugggcacacccgauuucguggggaaaauccagggaaugcuuacgcagaccacaaagggcgacgggagcacccggggacacaaggcuacagucuacaccggcuccgccccguuuacgccuaaacuggggucugugcaguucgaaacagacaccgagaacgauuuugaaacccaucaaaauacaaaguucacccccguuggagugauucaggacggcggcacaacgcaccgcaacgagccccagcaauggguccucccuagcuacuccgggagaaaugugccgaacguucaccuggcccccgcuguggccccuaccuuucccggagagcagcuucuguucuuucggagcacaaugccuggcuguucuggguaucccaauauggaucucgacugccugcugccucaggaauggguccagcauuucuaccaagaggcggcucccgcccaguccgauguggcccuccugcgcuuugugaacccggacaccggaagaguucuuuucgaauguaaacugcacaagagcggcuaugucacaguggcucauaccgggcagcacgaucucgugaucccucccaacggcuacuuucgguucgacucuugggucaaucaguucuauacgcuggccccuaugggaaacggcaccgggagacgccgggcucuuuga

SEQ ID NO: 27100 - RNA, 1623 nt, Artificial Sequence
  derived and/or modified sequence opt5 from VP1__Norovirus__AGK25902
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccgccuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcucugcuuucgugguccagccucagaauggacgguguacaaccgacggcgugcuccuggggacgacacaacugucccccguuaacaucugcaccuuucgcggagaugugacacauaucgcgggcagcagaaauuacaccaugaaccucgccucucugaauuggaacaauuaugacccuaccgaagagauucccgcuccucuuggcacacccgauuucgucgggaaaauccagggaaugcugacgcagaccacaaagggcgacggguccacccggggacacaaggccacaguguacaccggcagcgccccguuuacgccuaaacucggguccguccaguucgaaacagacaccgagaacgauuuugaaacccaucaaaauacaaaguucacccccgugggaguuauucaggacggcggcacagcucaccgcaacgagccccagcaaugggugcugccuucuuacagcgggagaaaugucccgaacgugcaccuugcccccgcgguugcuccuacguuucccggagagcagcuccuguucuuucgguccaccaugccuggcuguagcggguaucccaauauggaucuggacugccugcucccucaggaaugggugcagcauuucuaccaagaggccgcccccgcucagucugaugucgcccugcuucgcuuugugaacccggacacaggaagagugcuguucgaauguaaacuccacaaguccggcuauguuaccgucgcucauacagggcagcacgaucuggugaucccucccaacggcuacuuucgguucgacagcugggugaaucaguucuauacccuugccccuaugggaaacggcacggggagacgccgggcgcuguga

SEQ ID NO: 27101 - RNA, 1623 nt, Artificial Sequence
  derived and/or modified sequence opt5 from VP1__Norovirus__AGK25905
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucgcccaggcgcccggcggggaauuuaccguuagcccucggaacgcccccggagagauucugugguccgcuccucuuggcccggaucugaaucccuaccucucucaccuggcccgcauguauaacggguacgcuggaggcuucgaagugcaggucauccuugccgagaaugcguuuacagccggcaaaauuaucuucgcugccgugccucccaacuuuccuacggaggggcugagccccuccagaguuaccauguucccgcauaucauuguggacguccggcagcucgaaccugugcugaucccccugccugaugugcgcaauaacuuuuaucacuacaaucaaucuaacgacagcacaauuaagcucaucgcuaugcuguauacaccccuuagagccaacaaugccggagaggaugucuucaccguuuccugccgggugcugacccgccccagcccugacuuugauuucauuuuucucgugccgcccacagucgaaucuagaaccaaaccuuucacggugcccauccugaccguugaggagacaaccaacucccgguuuccuauuccccuugaaaagcuguucacaggcccgagcucugcuuucgugguccagccucagaaugggcgcuguaccacggacggagugcuccugggcacaacccagcugucccccguuaacaucugcacauuuagaggggaugugacccauaucgcgggaagccggaauuacaccaugaaccucgccucucugaauuggaacaauuaugucccuacagaggaaauucccgcuccucuuggcacgcccgacuucgugggcaaaguccaagggaugcugacccagacaaccaagggagauggcuccacacgcgggcacaaggccaccguguacacgggaagcgccccguuuacaccuaaacucggcuccguucaguucgagaccgacaccgaaaacgacuuugagacacaucagaauaccaaguucacacccgugggggucauccaagauggaggcacgacccacagaaacgagccccagcagugggugcugccuucuuacagcggccggaauguuccgaacgugcaccuugcucccgccgucgcgccuacauuucccggggaacaacuccuguucuuucgcuccaccaugccuggauguagcggcuaucccaauauggaccuggauugccugcucccucaggagugggugcagcauuucuaccaggaagcugcccccgcccaaucugacguggcucugcuuagauuuguuaacccggauacagggcggguccuguucgaguguaaacuccacaaguccggauaugugaccguggcccauacgggccagcacgaccuggucauuccucccaacggguacuuuagauucgauagcugggugaaucaguucuauacccuugcuccuaugggcaacggaacaggccgccggagagcccuguga

SEQ ID NO: 27102 - RNA, 1623 nt, Artificial Sequence
  derived and/or modified sequence opt5 from VP1__Norovirus__AGK25908
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccacgguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcucugccuucgucgugcagccucagaauggacgguguaccacggacggcguucuccuggggacaacccaacugucccccgugaacaucugcacauuucgcggagaugucacccauaucgccggcagcagaaauuacaccaugaaccucgcuucucugaauuggaacaauuaugacccuacagaagagauucccgcgccucuuggcacgcccgauuucguggggaaaauccagggaguccugacccagacaaccaagggcgacggguccacacggggacacaaggccaccguguacacgggcagcgcuccguuuacaccuaaacucggguccguucaguucgaaaccgacaccgagaacgauuuugaaacacaucaaaauaccaaguucacacccgugggagucauucaggacggcggcacgacccaccgcaacgagccccagcaaugggugcugccuucuuacagcgggagaaauguuccgaacgugcaccuugcccccgccgucgcuccuacauuucccggagagcagcuccuguucuuucgguccaccaugccuggcuguagcggguaucccaauauggaucuggacugccugcucccucaggaaugggugcagcauuucuaccaagaggccgcgcccgcucagucugauguggcccugcuucgcuuuguuaacccggacacaggaagaguccuguucgaauguaaacuccacaaguccggcuaugugaccguggcccauacggggcagcacgaucuggucaucccucccaacggcuacuuucgguucgacagcugggugaaucaguucuauacccuugcuccuaugggaaacggcacagggagacgccgggcccuguga

SEQ ID NO: 27103 - RNA, 1623 nt, Artificial Sequence
  derived and/or modified sequence opt5 from VP1__Norovirus__AGK25910
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccuuccaauuuucccacggagggacugucuccuagccaggucaccauguucccccauaucaucguggacgugagacaacucgagccgguccugauuccucugcccgauguucggaacaauuuuuaucacuacaaccaguccaaugacagcacaaucaagcucauugccaugcuguauacccuucugcgcgcuaacaacgccggcgaugacguguucacagugucuugcagaguccucacccggccuucccccgauuuugacuucaucuuucuggugcccccuacaguugaaagccgcaccaaaccguucucugugcccguccuuacgguggaggaaaugaccaauuccagauuuccuauuccccuggagaagcuguucacagggccuagcucugccuucguugugcagccccagaacggacgguguaccacagauggcguccugcuggggaccacgcaacucuccccggugaauaucugcacauuucgcggagacgucacccauauuacaggcagcagaaacuacaccaugaaucuggcuucccagaacuggaauaacuaugauccuaccgaggaaauccccgcgccucuuggcacacccgacuucguggggaaaauccagggaaugcugacgcagaccacacggaccgacggcucuacacgcgggcacaaggccaccauguacacgggaagcgcugauuuugccccuaagcucggcagaguucaauucgagacagacaccgaucaugacuuugaagccaaucagaacaccaaauucacacccgugggggucauucaggauggaggcaccacacaccggaaugagccgcaacagugggugcugccuuccuacagcggccgcaacacgcacaauguucaucuugcucccgccguggcgcccaccuuuccuggggaacagcuccucuucuuuagaccgacaaugcccggauguucuggcuauccuaacauggaccuggaucggcugcucccccaggaguggguccaauacuucuaucaggaggcugccccugcccaguccgacguggcucugcuuagauuugugaaucccgauaccgggcgcguucuguucgaaugcaagcuccacaaaagcggauacgucacaguggcccauaccggccagcacgaccuggugaucccucccaacggguauuuucgguucgauucuugggucaaccaauucuacacgcuugcuccgaugggcaauggaaccggcagacgccgggugguuuga

SEQ ID NO: 27104 - RNA, 1623 nt, Artificial Sequence
  derived and/or modified sequence opt5 from VP1__Norovirus__AGK25912
augaagauggccagcaacgacgcuaaucccuccgauggcucugccgcgaaccuggugccugaggucgacaaugaaguuauggcucucgagccgguggugggggccgccaucgcugcccccgucgcuggacagcaaaacgugauugauccuuggaucagaaauaacuucguucaggcccccggcggggaauuuaccgugagcccucggaaugcgcccggagagauucugugguccgccccucuuggcccggaccugaaccccuaccucucucaccuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcauaucauugucgaugugagacaacucgagccugugcugaucccccugccugacguccggaacaauuuuuaucacuacaaccagucuaaugauagcacaauuaagcucaucgccaugcuguauacaccccuucgcgcuaacaacgccggcgaagacguuuucaccguguccugcagagugcugacccggcccagcccugauuuugacuucauuuuucucgccccgcccacagucgagucucgcaccaaaccuuucacggugcccauccugaccguugaagagaugacaaauuccagauuuccuauuccccuugagaagcuguucaccgggccgagcucugcuuucgugguccagccucagaacggacgguguacaaccgauggcgugcuccuggggacgacacaacugucccccguuaauaucugcaccuuucgcggagacgugacacauaucgcgggcagcagaaacuacaccaugaaucucgccucucugaacuggaauaacuaugauccuaccgaagagauucccgcuccucuuggcacacccgacuucgucgggaaaauccagggaaugcugacgcagaccacaaagggcgacggguccacccggggacacaaggccacaguguacaccggcagcgccccguuuacgccuaaacucggguccguccaguucgaaacagauaccgagaaugacuuugaaacccaucaaaacacaaaguucacccccgugggaguuauucaggauggcggcacaacgcaccgcaaugagccccagcaaugggugcugccuucuuacagcgggagaaacgucccgaaugugcaccuugcucccgccguugcgccuaccuuucccggagagcagcuccuguucuuucgguccacaaugccuggcuguagcggguaucccaacauggaccuggauugccugcucccucaggaaugggugcagcauuucuaccaagaggcugcccccgcccagucugacgucgcucugcuucgcuuugugaauccggauaccggaagagugcuguucgaauguaaacuccacaaguccggcuauguuacagucgcccauaccgggcagcacgaccuggugaucccucccaacggcuacuuucgguucgauagcugggugaaccaguucuauacgcuugcuccuaugggaaauggcaccgggagacgccgggcccuguga

SEQ ID NO: 27105 - RNA, 1623 nt, Artificial Sequence
  derived and/or modified sequence opt5 from VP1__Norovirus__AGK25915
augaagauggccagcaacgacgcuaaucccuccgauggcucugccgugaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaucauuguggacgcuagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucgcucauaucgcgggcagcagaaauuacacaaugaaccucgccucucugaauuggaacaauuaugacccuaccgaagagauucccgcuccucuuggcacccccgauuucguggggaaaauccagggaaugcugacacagacgaccaagggcgacggguccacacggggacacaaggccaccgucuacacaggcagcgccccguuuaccccuaaacucggguccgugcaguucgaaacggacacagagaacgauuuugaaacccaucaaaauaccaaguucacacccguuggagugauucaggacggcggcaccacacaccgcaacgagccccagcaauggguccugccuucuuacagcgggagaaaugugccgaacguucaccuugcucccgccguggcgccuacguuucccggagagcagcugcuccuguuccgguccaccaugccuggcuguagcggguaucccaauauggaucuggacugccuccugccucaggaauggguccagcauuuuuaccaagaggcugcccccgcccagucugauguggcccuucugcgcuucgugaacccggacacaggaagaguucucuuugaauguaaacugcacaaguccggcuaugucaccguggcucauacagggcagcacgaucuugugaucccucccagcggcuacuuccgguuugacucuugggucaaccaguucuauacccuggcuccuaugggaaauggcacggggagacgccgggcccucuga

SEQ ID NO: 27106 - RNA, 1623 nt, Artificial Sequence
  derived and/or modified sequence opt5 from VP1__Norovirus__AGK25917
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccggguuuccuauuccccuugagaagcuguucaccggaccgagcucugccuucgucgugcagccucagaauggcagauguacaaccgacgggguucuccugggaacgacacaacugucccccgugaacaucugcaccuuucggggcgaugucacacauaucgcuggcagccgcaauuacaccaugaaccucgcgucucugaauuggaacaauuaugacccuaccgaagagauucccgccccucuugggacacccgauuucgugggaaaaguccagggcgugcugacgcagaccacaaagggggacggauccaccagaggccacaaggcuacaguuuacaccgggagcgccccguuuacgccuaaacucggauccgugcaguucgaaacagacaccgagaacgauuuugaaacccaucaaaauacaaaguucacccccgucggcgugauccaggacggcgggacagcccaccggaacgagccccagcaauggguucugccuucuuacagcggacgcaaugugccgaacguccaccuugcucccgccguggcgccuacguuucccggcgagcagcuccuguucuuuagauccaccaugccuggguguagcggauaucccaauauggaucuggacugccugcucccucaggaaugggugcagcauuucuaccaagaggcugcccccgcccagucugauguugcucugcuucgguuugucaacccggacacaggccgcgugcuguucgaauguaaacuccacaaguccggguaugugaccgucgcccauacaggccagagagaucuggugauuccucccaacggauacuuucgguucgacagcuggguuaaucaguucuauacccuugcuccuaugggcaacgggacgggaagacgccgggcccuguga

SEQ ID NO: 27107 - RNA, 1623 nt, Artificial Sequence
  derived and/or modified sequence opt5 from VP1__Norovirus__AGK25919
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaccccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaagccaaucagaacacaaaauucacccccguuggggugauccaggauggaggcacaacgcaccggaaugagccccaacaguggguccucccuucuuacagcggccgcaacacccacaaugugcaucuggcuccggccguggcgcccacauuuccuggggaacagcuucuguucuuuagauccaccaugcccggauguagcggcuauccuaacauggaccucgauugccugcugccccaggaguggguucaauacuucuaucaggaggcugccccugcccacucugacgucgcucuccugcgguuugugaaucccgauacagggagagugcuuuucgaauguaagcugcauaaauccggauacgucaccguggcccacacgggccagcacgaccucguuaucccgccuaacggguauuuucgcuucgauagcugggugaaccaguucuacacccuggcucccaugggcucuggaacaggccggagacgcgccgucuga

SEQ ID NO: 27108 - RNA, 1623 nt, Artificial Sequence
  derived and/or modified sequence opt5 from VP1__Norovirus__AGK25921
augaagauggccagcuccgacgcuaaccccucugauggcagcgccgcgaaucuggugccugaggucaacaaugaaguuauggcucucgagccgguggccggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaagugauuuucgcugccguuccucccaauuuuccuacggagggacugucccccucucaggugaccauguucccgcauaucgucguggacgugagacaacucgagccuguccugaucccccugccugauguucggaacaauuuuuaucacuacaaccagagcaaugaccccacaauuaagcucaucgcuaugcuguaugcuccccuucgcgccaacaacgccggcgaugacguguucaccguguccugcagaguccugacacggccuagcccggauuuugacuucauuuuucucgugcccccuaccguugaaucucgcacaaaacccuucuccgugccuguccugaccguggaggaaaugacgaauagcagauuucccaucccgcuugagaagcuguucaccgggccuucuuccgcguucguugugcagccccagaacggacgguguacaaccgauggcguccuccuggggacaacccaacugagcccugugaauauuugcacguuucgcggagacgucacacauaucaccggcucuagaaacuacacaaugaaucucgccucccagaacuggaauaacuaugaucccaccgaggaaauuccugcuccccugggcaccccggacuucguggggaaaauccagggaguucuuacacagacgacccggacagacggcagcacccgcgggcacaaggccacaguguacaccggauccgccgauuuugcuccuaagcugggcagaguccaauucgagacggacacagaucaugacuuugaagccaaucagaacaccaaauucacccccguggggguuauccaggauggaggcacaacccaccggaaugagccccaacagugggugcucccuucuuacagcggccgcaacacacacaauguccaucuggcgccggcuguggcccccacguuuccuggggaacagcuucuguucuuuagauccaccaugcccggauguagcggcuauccuaacauggaccucgauugccugcugccccaggagugggugcaauacuucuaucaggaggccgcuccugcccagucugacguugcucuccugcgguuugucaaucccgauacagggagagugcuuuucgaauguaagcugcacaaauccggauacgugaccgucgcccauacaggccagcacgaccucgugauuccgccuaacggguauuuucgcuucgauagcuggguuaaccaauucuacacccuggcgcccaugggcaauggaacgggccggagacgcgccguguga

SEQ ID NO: 27109 - RNA, 1623 nt, Artificial Sequence
  derived and/or modified sequence opt5 from VP1__Norovirus__AGK25924
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcugucuacagggccuuccagcgccuucgugguccagccccagaacggacgguguaccacagauggcgugcuccuggggaccacgcaacugucuccugucaauauuugcacauuccgcggagacgugacccauaucacaggcuccagaaacuacaccaugaaucucgcuagccagaacuggaauaacuaugaucccaccgaggaaauuccugcgccccugggcacaccggacuuuguugggaaaauccagggagugcuuacgcagaccacacggaccgacggcuccacacgcgggcacaaggccaccgucuacacgggaucugcugauuucgccccuaagcugggcagagugcaauuugagacagacaccgaucaugacuucgaagccaaucagaacaccaaauuuacacccguuggggugauccaggauggaggcaccacacaccggaaugagccccaacaguggguccucccuagcuacuccggccgcaacacgcacaaugugcaucuggcuccggccguggcgcccaccuucccuggggaacagcuucuguuuuucagaagcacaaugcccggauguucuggcuauccuaacauggaccucgauugccugcugccccaggaguggguucaauacuuuuaucaggaggcugccccugcccaguccgacgucgcucuccugcgguucgugaaucccgauaccgggagagugcuuuuugaauguaagcugcacaaaagcggauacgucacaguggcccauaccggccagcacgaccucguuauuccgccuaacggguauuuccgcuuugauucuugggugaaccaauucuacacgcuggcucccaugggcaauggaaccggccggagacgcgccgucuga

SEQ ID NO: 27110 - RNA, 1623 nt, Artificial Sequence
  derived and/or modified sequence opt5 from VP1__Norovirus__AGK25927
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguaugcuccccuucgcgccaacaacgccggcgaugacguguucaccgucuccugcagagugcugacacggccuagcccggauuuugacuucauuuuucucguucccccuaccguggaaucucgcacaaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggaauaacuaugaucccaccgaggaaauuccugcuccccugggcaccccggacuucguugggaaaauccagggagugcuuacacagacgacccggacagacggcagcacccgcgggcacaaggccacagucuacaccggauccgccgauuuugccccuaagcugggcagagugcaauucgagacggacacagaucaugacuuugaagcuaaucagaacaccaaauucacccccguuggggugauccaggauggaggcacaacccaccggaaugagccccaacaguggguccucccuucuuacagcggccgcaacacacacaaugugcaucuggccccggcgguggcucccacguuuccuggggaacagcuucuguucuuuagauccaccaugcccggauguagcggcuauccuaacauggaccucgauugccugcugccccaggaguggguucaauacuucuaucaggaggccgccccugcucagucugacgucgcccuccugcgguuugugaaucccaacacagggagagugcuuuucgaauguaagcugcacaaauccggauacgucaccguggcucauacaggccagcacgaucucguuauuccgccuaacgacuauuuucgcuucgauagcugggugaaucaauucuacacccuggcccccauggggaacggcacgggacggagacgcgcggucuga

SEQ ID NO: 27111 - RNA, 1623 nt, Artificial Sequence
  derived and/or modified sequence opt5 from VP1__Norovirus__AGK25930
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugggcaacaauuuuuaucacuacaaccagagcaaugaccccacaauuaagcucaucgccaugcuguauacaccccuucgggcuaacaacgccggggaugacguguucaccgucuccugccgcgugcugaccagaccuagcccggauuuugacuucauuuuucucguucccccuacaguggaaucucggaccaaacccuucuccgucccugugcugacgguugaggaaaugaccaauagccgcuuucccaucccgcuugagaagcuguucacaggaccuucuuccgccuucgugguccagccccagaacggcagauguaccacagauggggugcuccugggaaccacgcaacugagcccugucaauauuugcacauuucggggcgacgugacccauaucacaggcucucgcaacuacaccaugaaucucgcuucccagaacuggaauaacuaugaucccaccgaggaaauuccugcgccccuggggacaccggacuucguuggaaaaauccagggcgugcuuacgcagaccacaagaaccgacgggagcacacggggacacaaggccaccgucuacacgggcuccgcugauuuugccccuaagcuggggcgcgugcaauucgagacagacaccgaucaugacuuugaagccaaucagaacaccaaauucacacccguuggagugauccaggauggcggcaccacacacagaaaugagccccaacaguggguccucccuucuuacagcgggcggaacacgcacaaugugcaucuggcuccggccguggcgcccaccuuuccuggagaacagcuucuguucuuucgcuccacaaugcccggcuguagcggguauccuaacauggaccucgauugccugcugccccaggaguggguucaauacuucuaucaggaggcugccccugcccagucugacgucgcucuccugagauuugugaaucccgauaccggacgggugcuuuucgaauguaagcugcacaaauccggcuacgucacaguggcccauaccgggcagcacgaccucguuauuccgccuaacggcuauuuuagauucgauagcugggugaaccaauucuacacgcuggcucccaugggaaauggcaccgggcgccggagagccgucuga

SEQ ID NO: 27112 - RNA, 1623 nt, Artificial Sequence
  derived and/or modified sequence opt5 from VP1__Norovirus__AGS08025
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacaaagaccaacggcuccacacgggggcacaaggcgaccguuuacacgggaucugccgacuuuagccccaaacugggccgcgugcaauucgcuacagauaccgacaaugauuuugagaccaaccagaauacaaaguucacccccgucggggugauccaggacggauccacaacgccuagaaacgaaccgcaacaguggguucuccccagcuacucuggccggaauauucauaacgugcaccuggccccugccgucgcucccaccuuuccuggcgagcagcuucuguucuuucgcuccacaaugcccggguguagcggauauccuaauauggaucucgacugccugcugccccaggaaugggugcaauacuucuaucaggaggccgcgccggcucagucugauguggcccuccugagauuuguuaacccugacaccggccggguccuuuucgaguguaaacugcacaagagcggguacgugacaguggcccauaccggacagcacgaucucgucauucccccuaacggcuauuuuagauucgacuccugggugaaucaauucuacacgcuggcucccauggggaacggcaccggacgccggagagcccuuuga

SEQ ID NO: 27113 - RNA, 1623 nt, Artificial Sequence; identical to SEQ ID NO: 26674
  derived and/or modified sequence opt5 from VP1__Norovirus__AGS08026

SEQ ID NO: 27114 - RNA, 1623 nt, Artificial Sequence
  derived and/or modified sequence opt5 from VP1__Norovirus__AGS08027
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucugcgaauggcagcaccagagggcauaaggccacaguguacaccggauccgcugacuuuagcccuaagcugggccggguucaauucgccacggauacaaauaacgacuuugagaccaaucagaacaccaaauucacacccgugggggucauucaggauggaaauaccacaccccgcaacgaaccucaacagugggugcucccgucuuacuccggcagaaauauccacaacguucaccuggcccccgcuguggccccuacguuucccggcgagcagcuucuguucuuucggagcaccaugccuggguguucuggauaucccaacauggaccucgauugccugcugccucaggaauggguccaauacuucuaucaggaggcggcucccgcccagagcgacguggcccuccugcgcuuugugaauccggauacaggcagaguucuuuucgaguguaagcugcauaaauccggguacgucaccguggcucacacaggacagcaugaccucgugauuccucccaacggcuauuuucgguucgauucuugggucaaucaauucuacacccuggccccuauggggaacggcacgggaagacgccgggcucuuuga

SEQ ID NO: 27115 - RNA, 1623 nt, Artificial Sequence
  derived and/or modified sequence opt5 from VP1__Norovirus__AGS08028
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggagaccgcuccugcccagucugacgucgcccuccugcgguuugugaaucccgauacagggagagugcuuuucgaauguaagcugcacaaauccugcuacgucaccguggcucauacgggacagcacgaccucguuauuccgccuaacggcuauuuucgcuucgauagcugggugaaccaauucuacacccuggcccccauggggaauggcacaggacggagacgcgcugucuga

SEQ ID NO: 27116 - RNA, 1623 nt, Artificial Sequence; identical to SEQ ID NO: 26522
  derived and/or modified sequence opt5 from VP1__Norovirus__AGS08029

SEQ ID NO: 27117 - RNA, 1623 nt, Artificial Sequence; identical to SEQ ID NO: 26522
  derived and/or modified sequence opt5 from VP1__Norovirus__AGS08030

SEQ ID NO: 27118 - RNA, 1623 nt, Artificial Sequence; identical to SEQ ID NO: 26522
  derived and/or modified sequence opt5 from VP1__Norovirus__AGS08031

SEQ ID NO: 27119 - RNA, 1623 nt, Artificial Sequence; identical to SEQ ID NO: 26482
  derived and/or modified sequence opt5 from VP1__Norovirus__AGS08032

SEQ ID NO: 27120 - RNA, 1623 nt, Artificial Sequence
  derived and/or modified sequence opt5 from VP1__Norovirus__AGS08033
augaagauggccagcuccgacgcuaaccccucugauggcagcguggccaaucuggucccugagguuaacaaugaagugauggcgcucgagccgguggucggggcugccaucgccgcucccguggccggacagcaaaacguuauugacccuuggaucagaaauaacuucgugcaggcucccggcggggaauuuaccgucuccccucggaaugcccccggagagauucuguggucugcgccucuuggcccggaucugaaccccuaccucagccaccuggcccgcauguauaauggguacgcuggaggcuucgaagugcagguuauccuugccggcaacgcuuuuacagccgggaaagugauuuucgcggccgucccucccaauuuuccuacggagggacugucccccucucaggugaccauguucccgcauaucguggucgacguuagacaacucgagccugugcugaucccccugccugaugugcggaacaauuuuuaucacuacaaccagagcaaugaccccacaauuaagcucaucgcuaugcuguauacaccccuucgcgccaacaacgcuggcgaugacgucuucaccguguccugcagaguucugacccggccuagcccggauuuugacuucauuuuucucgugcccccuacagucgaaucucgcaccaaacccuucuccgugccuguucugacgguggaggaaaugaccaauagcagauuucccaucccgcuugagaagcuguucacagggccuucuuccgccuucgucgugcagccccagaacggacgguguaccacagauggcguccuccuggggaccacgcaacugagcccugugaauauuugcacauuucgcggagacguuacccauaucacaggcucuagaaacuacaccaugaaucucgccucccagaacuggaauaacuaugaucccaccgaggaaauuccugcuccccugggcacaccggacuucguggggaaaauccagggaguccuuacgcagaccacacggaccgacggcagcacacgcgggcacaaggcgaccguguacacgggauccgccgauuuugcuccuaagcugggcagaguucaauucgagacagacaccgaucaugacuuugaagccaaucagaacaccaaauucacacccgugggggucauccaggauggaggcaccacacaccggaaugagccccaacagugggugcucccuucuuacagcggccgcaacacgcacaaugugcaucuggccccggcuguugcccccaccuuuccuggggaacagcuucuguucuuuagauccacaaugcccggauguagcggcuauccuaacauggaccucgauugccugcugccccaggaguggguccaauacuucuaucaggaggcggcuccugcccagucugacguggcccuccugcgguuugugaaucccgauaccgggagaguccuuuucgaauguaagcugcacaaauccggauacgugacaguugcucauaccggccagcacgaccucgugauuccgccuaacggguauuuucgcuucgauagcugggucaaccaauucuacacgcuggcccccaugggcaauggaaccggccggagacgcgcuguguga

SEQ ID NO: 27121 - RNA, 1623 nt, Artificial Sequence
  derived and/or modified sequence opt5 from VP1__Norovirus__AGS08035
augaagauggccagcuccgacgcuaaccccucugauggcagcaccgccucccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacucuuacgcugggggauucgaaguccaggugauccuugccggcaaugcuuuuacggccggcaaaauuaucuucgcggccguuccucccaacuuuccuaccgaggggcugagccccucccaggugacaauguucccgcauaucauugucgacgugagacaacucgagccugugcugaucccccugccugauguccggaauaacuuuuaucacuacaaucagagcaacgaccccaccauuaagcucaucgcuaugcuguauacaccccuucgcgccaauaacgcuggagaugacguuuucaccgugucuugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccggcccuagcucugccuucgugguucagccccagaaugggcgguguacaaccgauggagugcuccugggcacgacacaacuguccccugucaacauuugcaccuuucgcggggacgugacacauaucagcggaucccacaauuacaccaugaaccucgccucucagaauuggaacagcuaugaucccaccgaggaaaucccugcuccccugggcacaccggacuucgucggcaaaauucagggggugcuuacgcagaccacaagaaucaauggauccacccggggccauaaggcgacaguuuacaccgggagcgccgacuuuucuccuaagcugggacgcgugcaauucgcuacggauacagacaacgauuuugagaccaaucagaacaccaaauucacacccgucggcgugauucaggacggguccaccacacccagaaaugaaccucaacaguggguucucccgagcuacucuggacggaacacgcacaaugugcaccuggcccccgccgucgcuccuaccuuucccggcgagcagcuucuguucuuucgcagcacaaugccuggcuguuccggguaucccaacauggaucucgacugccugcugccucaggaaugggugcaauacuucuaucaggaggccgcgcccgcucagucugauguggcccuccugagauuuguuaauccggacaccggacggguccuuuucgaguguaagcugcauaaaagcggcuacgugacaguggcccacaccgggcagcaugaucucgucaucccucccaacggauauuuuagauucgacuccugggugaaccaauucuacacgcuggcuccuaugggcaaugggaccggccgccggagagcccuuuga

SEQ ID NO: 27122 - RNA, 1623 nt, Artificial Sequence; identical to SEQ ID NO: 26674
  derived and/or modified sequence opt5 from VP1__Norovirus__AGS08036

SEQ ID NO: 27123 - RNA, 1623 nt, Artificial Sequence; identical to SEQ ID NO: 26522
  derived and/or modified sequence opt5 from VP1__Norovirus__AGS08037

SEQ ID NO: 27124 - RNA, 1623 nt, Artificial Sequence
  derived and/or modified sequence opt5 from VP1__Norovirus__AGS08038
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaugccaaucagaacaccaaauucacacccguuggggugauccaggacggaggcaccacacaccggaaugaaccccaacaguggguccucccuucuuacagcggccgcaacacgcacaaugugcaucuggcuccggccguggcgcccaccuuuccuggggagcagcuucuguucuuuagauccacaaugcccggauguagcggcuauccuaacauggaucucgacugccugcugccccaggaauggguucaauacuucuaucaggaggcugccccugcccagucugaugucgcucuccugcgguuugugaaucccgacaccgggagagugcuuuucgaguguaagcugcacaaauccggauacgucacaguggcccauaccggccagcacgaucucguuauuccgccuaacggguauuuucgcuucgacagcugggugaaccaauucuacacgcuggcucccaugggcaauggaaccggccggagacgcgccgucuga

SEQ ID NO: 27125 - RNA, 1623 nt, Artificial Sequence; identical to SEQ ID NO: 26522
  derived and/or modified sequence opt5 from VP1__Norovirus__AGS08040

SEQ ID NO: 27126 - RNA, 1623 nt, Artificial Sequence; identical to SEQ ID NO: 26674
  derived and/or modified sequence opt5 from VP1__Norovirus__AGS08041

SEQ ID NO: 27127 - RNA, 1623 nt, Artificial Sequence; identical to SEQ ID NO: 26482
  derived and/or modified sequence opt5 from VP1__Norovirus__AGS08042

SEQ ID NO: 27128 - RNA, 1623 nt, Artificial Sequence
  derived and/or modified sequence opt5 from VP1__Norovirus__AGS08043
augaagauggccagcuccgacgcuaaccccucugauggcagcaccgccaaucuggugccugaggucuccaacgaaguuauggcgcucgagccgguggugggggcugccaucgccgcucccgucgccggacagcaaaaugugauugacccuuggaucagaaacaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgacagcaccauuaagcucaucgcuaugcuguauacaccccuucgcgccaauucugcuggcgaugacguuuucaccguguccugcagagugcugacacggcccagcccugauuuugacuucauuuuucucgucccgcccaccguggaaucucgcacgaaaccuuucuccguucccauccugaccguggaggaaaugacaaacagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucccuggcucccacaacuacaccaugaaucucgccucucagaacuggaauagcuaugaucccaccgaggaaauuccugcuccccugggcacaccggacuucguggggaaaauccagggaguccuuacgcagaccacauccaccaacggcagcacaagagggcauaaggcgaccguguacacgggaucugccgacuuuuccccuaagcugggccggguucaauucgcuacagauaccaauaacgacuuugagaccaaucagaacacaaaauucacccccgugggggucauucaggauggaagcacaacgccccgcaaugaaccucaacagugggugcucccgucuuacagcggcagaaacauccacaauguucaccuggcccccgccguggcuccuaccuuucccggcgagcagcuucuguucuuucgguccacaaugccuggguguucuggauaucccaacauggaccucgauugccugcugccucaggaauggguccaauacuucuaucaggaggccgcgcccgcucagagcgacguggcccuccugcgcuuugugaauccggauaccggcagaguucuuuucgaguguaagcugcauaaauccggguacauuacagucgcccacaccggacagcaugaccucgugaucccucccaacggcuauuuucgguucgauagcugggugaaccaauucuacacgcuggcuccuauggggaauggcaccggaagacgccgggcccuuuga

SEQ ID NO: 27129 - RNA, 1623 nt, Artificial Sequence
  derived and/or modified sequence opt5 from VP1__Norovirus__AGS08044
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucgcuacagauaccaauaacgacuuugagaccaaucagaacacaaaauucacccccgugggggucauucaggauggaucuacaacgccccgcaaugaaccucaacagugggugcucccguccuacagcggcagaaacauccacaauguucaccuggcccccgccguggcuccuaccuuucccggcgagcagcuucuguucuuucggucuacaaugccuggguguagcggauaucccaacauggaccucgauugccugcugccucaggaauggguccaauacuucuaucaggaggccgcgcccgcucaguccgacguggcccuccugcgcuuugugaacccggauaccggcagaguucuuuucgaguguaagcugcauaaaucuggguacgucacaguggcccacaccggacagcaugaccucgugauuccucccaauggcuauuuucgguucgauagcugggucaaccaauucuacacgcuggcuccuauggggaauggcaccggaagacgccgggcccuuuga

SEQ ID NO: 27130 - RNA, 1623 nt, Artificial Sequence
  derived and/or modified sequence opt5 from VP1__Norovirus__AGS08045
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccgugccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuaccggcucuagaaacuacaccaugaaucucgccucccagaacuggaauagcuaugaucccacagaggaaaucccugcuccccugggcacgccggacuucguggggaaaauccagggaguucuuacccagacaacccggacaaacggcuccacccgcgggcacaaggcgacgguguacacaggaucugccgacuuuagcccuaagcugggcagaguccaauucgcuaccgauaccgacaaugauuuugagacaaaccagaauaccaaauucacacccguggggguuauucaggacggauccacgacaccccggaacgaaccucaacagugggugcucccgagcuacucuggccgcaauauccauaacguccaccuggcccccgccguggcuccuaccuuucccggcgagcagcuucuguucuuuagauccaccaugccuggguguagcggauaucccaauauggaucucgacugccugcugccucaggaaugggugcaauacuucuaucaggaggccgcgcccgcucagucugauguugcccuccugcgguuugucaacccggacacaggcagagugcuuuucgaguguaagcugcacaaaagcggguacgugaccgucgcccauacgggacagcacgaucucgugauuccucccaacggcuauuuucgcuucgacuccuggguuaaucaauucuacacccuggcuccuauggggaacggcacaggacggagacgcgcccuuuga

SEQ ID NO: 27131 - RNA, 1623 nt, Artificial Sequence
  derived and/or modified sequence opt5 from VP1__Norovirus__AGS08047
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccggcccuuccagcgccuucgugguucagccccagaacgggcgguguacaaccgauggagugcuccugggcacgacacaacugucuccugucaauauuugcaccuuucgcggggacgugacacauaucuccggaagcagaaacuacaccaugaaucucgccucccagaacuggaacucuuaugaucccaccgaggaaaucccugcuccccugggcacaccggacuucgucggcaaaauucagggggugcuuacgcagaccacacggaccgacggaagcacacgcggccacaaggcgaccguuuacacgggguccgccgauuuuagcccuaagcugggaagagugcaauucgcuacagacaccgauaaugacuuugucaccaaucagaacacaaaauucacccccgugggcguuauccaggaugggucuacaacgccccggaaugagccucaacagugggugcucccguccuacagcggacgcaacacccauaauguccaccuggcccccgccguggcuccuacauuucccggcgaacagcuucuguucuuuagaucuaccaugccuggcuguagcggguaucccaacauggaccucgauugccugcugccucaggagugggugcaauacuucuaucaggaagccgcgcccgcucaguccgacguugcccuccugcgguuugucaauccggauacaggaagagugcuuuucgaguguaagcugcacaaaucuggcuacgugaccgucgcccauacggggcagcacgaccucgugauuccucccaacggauauuuucgcuucgauagcuggguuaaccaauucuacacccuggcuccuaugggcaaugggacaggccggagacgcgcccuuuga

SEQ ID NO: 27132 - RNA, 1623 nt, Artificial Sequence; identical to SEQ ID NO: 26674
  derived and/or modified sequence opt5 from VP1__Norovirus__AGS08048

SEQ ID NO: 27133 - RNA, 1623 nt, Artificial Sequence
  derived and/or modified sequence opt5 from VP1__Norovirus__AGS08050
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgccgaacgugcaccuggcucccgccguggcgccuaccuuucccggcgaacagcuucuguucuuuagaucuacaaugccuggguguuccggauaucccaauauggaccucgauugccugcugccucaggaguggguucaauacuucuaucaggaggcugcccccgcccagagcgacgucgcucuccugcgguuugugaacccggauaccggcagagugcuuuucgaauguaagcugcauaaaucuggguacgucacaguggcccacaccggacagcaugaccucguuauuccucccaauggcuauuuucgcuucgauagcugggugaaccaauucuacacgcuggcuccuauggggaacggcaccggacggagacgcgcccuuuga

SEQ ID NO: 27134 - RNA, 1623 nt, Artificial Sequence
  derived and/or modified sequence opt5 from VP1__Norovirus__AGS08051
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcgccuuucgcggagacgugacccauaucucuggcuccagaaacuacacaaugaaucucgcuagccagaacuggaacuccuaugaucccaccgaggaaaucccugcgccccugggcaccccggacuucgucgggaaaauucagggaaugcuuacacagacgacccggacagacggcucuacccgcgggcacaaggccacaguguacaccggaagcgcugauuuuuccccuaagcugggcagaguucaauucgccacggacacagauaaugacuuugugaccaaucagaacaccaaauucacacccgucggggugauccaggauggaagcaccacaccccggaaugagccucaacaguggguucucccgucuuacuccggccgcaacacgcauaaugugcaccuggcccccgcugucgccccuaccuuucccggcgaacagcuucuguucuuuagaagcacaaugccuggguguucuggauaucccaacauggaccucgauugccugcugccucaggagugggugcaauacuucuaucaggaagcggcucccgcccagagcgacguggcccuccugcgguuuguuaauccggauaccggcagaguccuuuucgaguguaagcugcacaaauccggguacgugacaguggcucauaccggacagcacgaccucgucauuccucccaacggcuauuuucgcuucgauucuugggugaaccaauucuacacgcuggccccuauggggaauggcaccggacggagacgcgcucuuuga

SEQ ID NO: 27135 - RNA, 1623 nt, Artificial Sequence
  derived and/or modified sequence opt5 from VP1__Norovirus__AGS08052
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgggacagacaccgaucaugacuuugaggccaaccagaauaccaaauucacacccguuggagugauccaggauggcagcaccacacaccggaacgaaccccaacaguggguccucccuuccuacagcggccgcaauacgccgaacgugcaccuggcucccgccguggcgccuaccuuucccggggagcagcuucuguucuuuagaucuacaaugccuggauguuccggcuaucccaauauggaccucgauugccugcugccucaggaauggguucaauacuucuaucaggaggcugcccccgcccagagcgacgucgcucuccugcgguuugugaacccggauaccgggagagugcuuuucgaguguaagcugcauaaaucuggauacgucacaguggcccacaccggccagcaugaccucguuauuccucccaauggguauuuucgcuucgauagcugggugaaccaauucuacacgcuggcuccuaugggcaacggaaccggccggagacgcgcccuuuga

SEQ ID NO: 27136 - RNA, 1623 nt, Artificial Sequence
  derived and/or modified sequence opt5 from VP1__Norovirus__AGS08054
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucgccgaucagaauaccaaauucacacccguggggguuauccaggacggaagcaccacaccccggaacgagccucaacagugggugcucccgucuuacuccggccgcaauacgcauaacguccaccuggcccccgcuguggccccuaccuuucccggcgaacagcuucuguucuuuagaagcacaaugccuggguguucuggauaucccaauauggaucucgacugccugcugccucaggagugggugcaauacuucuaucaggaagcggcucccgcccagagcgauguugcccuccugcgguuugucaacccggacaccggcagagugcuuuucgaguguaagcugcacaaauccggguacgugacagucgcucauaccggacagcacgaucucgugauuccucccaauggcuauuuucgcuucgacucuuggguuaaccaauucuacacgcuggccccuauggggaacggcaccggacggagacgcgcucuuuga

SEQ ID NO: 27137 - RNA, 1623 nt, Artificial Sequence
  derived and/or modified sequence opt5 from VP1__Norovirus__AGS08056
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaggcaccacacaucgcaacgagccccaacaguggguccucccuagcuacuccggcagaaauacgccgaacgugcaccuggcucccgccguggcgccuaccuuucccggggaacagcuucuguucuuucggagcacaaugccuggauguucuggcuaucccaauauggaccucgauugccugcugccucaggaguggguucaauacuucuaucaggaggcugcccccgcccaguccgacgucgcucuccugagauuugugaacccggauaccgggcgcgugcuuuucgaauguaagcugcacaaaagcggauacgucacaguggcccauaccggccagcacgaccucguuauuccucccaauggguauuuucgguucgauucuugggugaaccaauucuacacgcuggcuccuaugggcaacggaaccggcagacgccgggcccuuuga

SEQ ID NO: 27138 - RNA, 1623 nt, Artificial Sequence
  derived and/or modified sequence opt5 from VP1__Norovirus__AGS08057
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacaucucuggcuccagaaauuacaccaugaaccucgccagccagaauuggaacuccuaugaucccaccgaggaaaucccugcuccccugggcacaccggacuucgucgggaaaauucagggagugcuuacgcagaccacacgggcggacggcucuacccgcgggcauaaggccacaguuuacaccggaagcgcugauuuuuccccuaagcugggcagagugcaauucgccacggacacagauaaugacuuugucgccaaccagaauaccaaauucacccccguggggguuauccaggauggaagcacaacaccccggaacgagccucaacagugggugcucccgucuuacuccggccgcaauacccacaacguccaccuggcucccgccguggcgccuacguuucccggcgaacagcuucuguucuuuagaagcaccaugccuggguguucuggauaucccaauauggaccucgauugccugcugccucaggagugggugcaauacuucuaucaggaagcugcccccgcccagagcgacguugcucuccugcgguuugucaacccggauacaggcagagugcuuuucgaguguaagcugcauaaauccggguacgugaccgucgcccacacaggacagcaugaccucgugauuccucccaauggcuauuuucgcuucgauucuuggguuaaccaauucuacacccuggcuccuauggggaacggcacgggacggagacgcgcccuuuga

SEQ ID NO: 27139 - RNA, 1623 nt, Artificial Sequence
  derived and/or modified sequence opt5 from VP1__Norovirus__AGS08058
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccagcacgaccucguuauuccgccuaacggguauuuucgcuucgauagcugggugaaccaauucuacacgcuggcucccaugggcaauggaaccggccggagacgcgccgucuga

SEQ ID NO: 27140 - RNA, 1623 nt, Artificial Sequence
  derived and/or modified sequence opt5 from VP1__Norovirus__AGS08059
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggaacgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucgugguggacgucagacaacucgagccuguucugaucccccugccugaugugcggaauaacuuuuaucacuacaaucagucuaacgaccccacaauuaagcucaucgccaugcuguauacaccccuucgcgcuaacaaugccggcgaugacguguucaccgucagcugcagagugcugacccggccuuccccggauuuugacuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagauggcgugcuccuggggaccacgcaacuguccccugucaacauuugcacauuucgcggagacgugacccauaucacaggcagcagaaauuacaccaugaaccucgcuucucagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaagcgcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuuccuacucuggccgcaauacgcacaacgugcaucuggcuccggccguggcgcccaccuuuccuggggaacagcuucuguucuuuagaagcacaaugcccggauguuccggcuauccuaauauggaccucgauugccugcugccccaggaguggguucaauacuucuaucaggaggcugccccugcccagagcgacgucgcucuccugcgguuugugaaccccgauaccgggagagugcuuuucgaauguaagcugcacaaaucuggauacgccacagucgcucauaccggccagcacgaccucgugauuccgccuaacggguauuuucgcuucgauuccuggguuaaucaauucuacacgcuggcccccaugggcaacggaaccggccggagacgcgcgguguga

SEQ ID NO: 27141 - RNA, 1623 nt, Artificial Sequence
  derived and/or modified sequence opt5 from VP1__Norovirus__AGS08060
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgccgaaugugcaccuggcucccgccguggcgccuaccuuucccggggaacagcuucuguucuuuagauccacaaugccuggauguagcggcuaucccaacauggaccucgauugccugcugccucaggaguggguucaauacuucuaucaggaggcugcccccgcccagucugacgucgcucuccugcgguuugugaauccggauaccgggagagugcuuuucgaauguaagcugcauaaauccggauacgucacaguggcccacaccggccagcaugaccucguuauuccucccaacggguauuuucgcuucgauagcugggugaaccaauucuacacgcuggcuccuaugggcaauggaaccggccggagacgcgcccuuuga

SEQ ID NO: 27142 - RNA, 1623 nt, Artificial Sequence; identical to SEQ ID NO: 26482
  derived and/or modified sequence opt5 from VP1__Norovirus__AGS08061

SEQ ID NO: 27143 - RNA, 1623 nt, Artificial Sequence; identical to SEQ ID NO: 27137
  derived and/or modified sequence opt5 from VP1__Norovirus__AGS08062

SEQ ID NO: 27144 - RNA, 1623 nt, Artificial Sequence; identical to SEQ ID NO: 27129
  derived and/or modified sequence opt5 from VP1__Norovirus__AGS08063

SEQ ID NO: 27145 - RNA, 1623 nt, Artificial Sequence; identical to SEQ ID NO: 26674
  derived and/or modified sequence opt5 from VP1__Norovirus__AGS08064

SEQ ID NO: 27146 - RNA, 1623 nt, Artificial Sequence; identical to SEQ ID NO: 26522
  derived and/or modified sequence opt5 from VP1__Norovirus__AGS08065

SEQ ID NO: 27147 - RNA, 1623 nt, Artificial Sequence; identical to SEQ ID NO: 27129
  derived and/or modified sequence opt5 from VP1__Norovirus__AGS08066

SEQ ID NO: 27148 - RNA, 1623 nt, Artificial Sequence; identical to SEQ ID NO: 26674
  derived and/or modified sequence opt5 from VP1__Norovirus__AGS08067

SEQ ID NO: 27149 - RNA, 1623 nt, Artificial Sequence
  derived and/or modified sequence opt5 from VP1__Norovirus__AGS08068
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcuccgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccucccagaauuggaacucuuaugaucccaccgaggaaaucccugcuccccugggcacaccggacuucgucgggaaaauucagggagugcuuacgcagaccacacggaccgacggcagcacacgcgggcacaaggcgaccguuuacacgggauccgccgauuuuagcccuaagcugggcagagugcaauucgcuacagacaccgauaaugacuuugucaccaaccagaauacaaaauucacccccguggggguuauccaggauggaucuacaacgccccggaacgagccucaacagugggugcucccguccuacagcggccgcaauacccauaacguccaccuggcccccgccguggcuccuacauuucccggcgaacagcuucuguucuuuagaucuaccaugccuggguguagcggauaucccaauauggaccucgauugccugcugccucaggagugggugcaauacuucuaucaggaagccgcgcccgcucaguccgacguugcccuccugcgguuugucaacccggauacaggcagagugcuuuucgaguguaagcugcacaaaucuggguacgugaccgucgcccauacgggacagcacgaccucgugauuccucccaauggcuauuuucgcuucgauagcuggguuaaccaauucuacacccuggcuccuauggggaacggcacaggacggagacgcgcccuuuga

SEQ ID NO: 27150 - RNA, 1623 nt, Artificial Sequence
  derived and/or modified sequence opt5 from VP1__Norovirus__AGS08069
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauacccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacgggacagcacgaucucgucauuccucccaacggcuauuuucgcuucgacucuugggugaaucaauucuacacccuggcuccuauggggaacggcacaggacggagacgcgcccuuuga

SEQ ID NO: 27151 - RNA, 1623 nt, Artificial Sequence
  derived and/or modified sequence opt5 from VP1__Norovirus__AGS08070
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucggcguccaggugauccuugcugggaacgccuuuacagcgggaaaaguuauuuucgccgcugugccucccaauuuuccuacggaaggccugucccccucucaggucaccauguucccgcauaucguggugaacgucagacaacucgagccuguucugaucccccugccugacgugcggaauaacuuuuaucacuacaaucagagcaacgaucccacaauuaagcucaucgccaugcuguauacaccccuucgcgcuaacaaugccggggacgauguguucacagucuccugcagagugcugacccggccuagcccggacuuugauuucauuuuucucguucccccuacaguggagucucgcaccaaacccuucuccgucccugugcugacgguugaagagaugaccaacagcagauuucccaucccgcuugaaaagcuguucacaggaccuucuuccgccuucgugguccagccccagaauggccgguguaccacagacggggugcuccugggaaccacgcaacugagcccugucaacauuugcacauuucgcggcgaugugacccauaucacaggcucuagaaauuacaccaugaaccucgcuucccagaauuggaacaauuaugaccccaccgaggagaccccugcgccccuggggacgccggauuucguuggaaaaauucagggcgugcuuacccagacaacccggacagacgggagcacccgcggacacaaggccacggucuacacaggcuccgcugacuuugccccuaagcuggggagagugcaauucgaaaccgauaccgaccaugauuuugaggccaaccagaauacaaaauucacccccguuggagugauccaggacggcucuacaacgcaccggaacgaaccccaacaguggguccucccuagcuacuccggccgcaauacccacaacgugcaucuggcuccggccguggcgcccacauuuccuggggagcagcuucuguucuuuagaagcaccaugcccggauguucuggcuauccuaauauggaucucgacugccugcugccccaggaauggguucaauacuucuaucaggaggcugccccugcccaguccgaugucgcucuccugcgguuugugaaccccgacacagggagagugcuuuucgaguguaagcugcacaaaagcggauacgucaccguggcccucacgggccagcaugaucugguuaucccgccuaacggguauuuucgcuucgacucuugggugaaucaauucuacacccuugcucccaugggcaacggaacaggccggagacgcgccgucuga

SEQ ID NO: 27152 - RNA, 1623 nt, Artificial Sequence; identical to SEQ ID NO: 27137
  derived and/or modified sequence opt5 from VP1__Norovirus__AGS08071

SEQ ID NO: 27153 - RNA, 1623 nt, Artificial Sequence; identical to SEQ ID NO: 26522
  derived and/or modified sequence opt5 from VP1__Norovirus__AGS08072

SEQ ID NO: 27154 - RNA, 1623 nt, Artificial Sequence; identical to SEQ ID NO: 27045
  derived and/or modified sequence opt5 from VP1__Norovirus__AGS08073

SEQ ID NO: 27155 - RNA, 1623 nt, Artificial Sequence; identical to SEQ ID NO: 27129
  derived and/or modified sequence opt5 from VP1__Norovirus__AGS08074

SEQ ID NO: 27156 - RNA, 1623 nt, Artificial Sequence; identical to SEQ ID NO: 26674
  derived and/or modified sequence opt5 from VP1__Norovirus__AGS08076

SEQ ID NO: 27157 - RNA, 1623 nt, Artificial Sequence; identical to SEQ ID NO: 26674
  derived and/or modified sequence opt5 from VP1__Norovirus__AGS08079

SEQ ID NO: 27158 - RNA, 1623 nt, Artificial Sequence; identical to SEQ ID NO: 27129
  derived and/or modified sequence opt5 from VP1__Norovirus__AGS08080

SEQ ID NO: 27159 - RNA, 1623 nt, Artificial Sequence
  derived and/or modified sequence opt5 from VP1__Norovirus__AGS08081
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaauuccugcuccccugggcacaccggacuucguggggaaaauccagggaguccuuacgcagaccacaucuaccaauggcagcacaagagggcauaaggcgaccguguacacgggauccgccgacuuuagcccuaagcugggccggguucaauucgugacagauaccaauaacgacuuugagaccaaucagaacacaaaauucacccccgucggggugauucaggauggaucuacaacgccccgcaaugaaccucaacaguggguucucccguccuacagcggcagaaacauccacaaugugcaccuggcucccgccgucgccccuaccuuucccggcgagcagcuucuguucuuucggucuacaaugccuggguguagcggauaucccaacauggaccucgauugccugcugccucaggaaugggugcaauacuucuaucaggaggcugcccccgcgcaguccgacguggcucuccugcgcuuuguuaacccggauaccggcagaguccuuuucgaguguaagcugcauaaaucuggguacgugacaguggcccacaccggacagcaugaccucgucauuccucccaauggcuauuuucgguucgauagcugggugaaccaauucuacacgcuggccccuauggggaauggcaccggaagacgccgggcucuuuga

SEQ ID NO: 27160 - RNA, 1623 nt, Artificial Sequence
  derived and/or modified sequence opt5 from VP1__Norovirus__AGS08082
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuacaccuaagcugggcagagugcaauucgcuaccgacaccgauaaugacuuugucacaaaucagaacaccaaauucacacccguggggguuauccaggauggauccacgacaccccggaaugagccucaacagugggugcucccgagcuacucuggccgcaacacccauaauguccaccuggcccccgccguggcuccuaccuuucccggcgaacagcuucuguucuuuagauccacaaugccuggguguagcggauaucccaacauggaccucgauugccugcugccucaggagugggugcaauacuucuaucaggaagccgcgcccgcucagucugacguugcccuccugcgguuugucaauccggauaccggcagagugcuuuucgaguguaagcugcacaaaagcggguacgugacggucgcccauaccggacagcacgaccucgugauuccucccaacggcuauuuucgcuucgauuccuggguuaaccaauucuacacacuggcuccuauggggaauggcaccggacggagacgcgcccuuuga

SEQ ID NO: 27161 - RNA, 1623 nt, Artificial Sequence; identical to SEQ ID NO: 26674
  derived and/or modified sequence opt5 from VP1__Norovirus__AGS08083

SEQ ID NO: 27162 - RNA, 1623 nt, Artificial Sequence
  derived and/or modified sequence opt5 from VP1__Norovirus__AGS08084
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcuaugaccccaccauuaagcucaucgcuaugcuguacacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacauauccccggcucucacaauuauaccaugaaccucgccucccagaauuggaacagcuacgauccuaccgaggaaauccccgcuccgcugggcacaccugacuucgucgggaaaauucagggagugcuuacgcagaccacaaagaccaauggcuccacaagagggcauaaggcgaccguuuacacgggaucugccgacuuuagccccaaacugggccgggugcaauucgcuacagauaccaacaaugacuuugagaccaaccagaauacaaaguucacccccgucggggugauccaggauggauccacaacgccucgcaacgaaccgcaacaguggguucuccccagcuauucuggcagaaauauucacaacgugcaccuggccccugccgucgcucccaccuuuccuggcgagcagcuucuguucuuucgguccacaaugcccggguguagcggauacccuaauauggaccucgauugccugcugccccaggaaugggugcaauauuucuaccaggaggccgcgccggcucagucugacguggcccuccugcgcuuuguuaacccugauaccggcagaguccuuuucgaguguaaacugcauaagagcggguaugugacaguggccuacaccggacagcacgaccucgucauucccccuaacggcuauuuucgguucgauuccugggugaaucaauucuacacgcuggcucccauggggaacggcaccggaagacgccgggcccuuuga

SEQ ID NO: 27163 - RNA, 1623 nt, Artificial Sequence
  derived and/or modified sequence opt5 from VP1__Norovirus__AGS08085
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgccacagucgcucauaccggccagcacgaccucgugauuccgccuaacggguauuuucgcuucgauagcuggguuaaccaauucuacacgcuggcccccaugggcaauggaaccggccggagacgcgcgguguga

SEQ ID NO: 27164 - RNA, 1623 nt, Artificial Sequence; identical to SEQ ID NO: 27129
  derived and/or modified sequence opt5 from VP1__Norovirus__AGS08086

SEQ ID NO: 27165 - RNA, 1623 nt, Artificial Sequence
  derived and/or modified sequence opt5 from VP1__Norovirus__AGS08087
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccucuacgauucuguggagcgcgccucuuggaccggaucugaaccccuaccucucccaccuggcccgcauguauaauggcuacgcugggggauucgagguccaggugauccuugccggcaacgcuuuuaccgccggcaaaauuaucuucgcggccguuccucccaauuuuccuacagaagggcugucucccagccaggugaccauguucccgcauaucauugucgacgugagacaacucgagccugugcugaucccccugccugauguccggaacaauuuuuaucacuacaaccaguccaaugaccccacaauuaagcucaucgcuaugcuguauacaccccuucgcgccaacaacgcuggagaugacguuuucaccgugagcugcagagugcugacccggccuucuccggauuuugacuucauuuuucucgugcccccuacggucgagucccgcaccaaacccuucagcguuccugugcugacagucgaagagaugaccaauucuagauuucccaucccgcuugaaaagcuguucacaggcccuuccagcgccuucgugguucagccccagaacgggcgguguaccacggauggagugcuccugggcacaacccaacugucuccugucaauauuugcacauuucgcggggacgugacccauaucuccggaagcagaaacuacaccaugaaucucgccucccagaacuggaacucuuaugaucccacagaggagaucccugcuccccugggcacgccggacuucgucggcaaaauucagggggugcuuacccagacaacccggacagacggaagcacccgcggccacaaggcgacgguuuacacaggguccgccgauuuuagcccuaagcugggaagagugcaauucgcuaccgacaccgauaaugacuuugucacaaaucagaacaccaaauucacacccgugggcguuauccaggaugggucuacgacaccccggaaugaaccucaacagugggugcucccguccuacagcggacgcaacauucauaauguccaccuggcccccgccguggcuccuaccuuucccggcgagcagcuucuguucuuuagaucuaccaugccuggcuguagcggguaucccaacauggaccucgauugccugcugccucaggaaugggugcaauacuucuaucaggaggccgcgcccgcucaguccgacguugcccuccugcgguuugucaauccggauacaggaagagugcuuuucgaauguaagcugcacaaaucuggcuacgugaccgucgcccauacggggcagcacgaccucgugaucccucccaacggauauuuucgcuucgauagcuggguuaaccaauucuacacccuggcuccuaugggcaaugggacaggccggagacgcgcccuuuga

SEQ ID NO: 27166 - RNA, 1623 nt, Artificial Sequence; identical to SEQ ID NO: 27129
  derived and/or modified sequence opt5 from VP1__Norovirus__AGS08088

SEQ ID NO: 27167 - RNA, 1623 nt, Artificial Sequence; identical to SEQ ID NO: 26482
  derived and/or modified sequence opt5 from VP1__Norovirus__AGS08089

SEQ ID NO: 27168 - RNA, 1623 nt, Artificial Sequence; identical to SEQ ID NO: 26674
  derived and/or modified sequence opt5 from VP1__Norovirus__AGS08090

SEQ ID NO: 27169 - RNA, 1623 nt, Artificial Sequence
  derived and/or modified sequence opt5 from VP1__Norovirus__AGS08091
augaagauggccagcuccgacgcuaaccccaccgauggcucugccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaugacguuuucaccguguccugcagagugcugacacggcccagcccugauuuugacuucauuuuucucgucccgcccaccguggaaucucgcacgaaaccuuucuccguucccgugcugaccgucgaggaaaugacaaauagcagauuuccuaucccccuugagaagcuguucaccgggccgucuuccgccuucgugguucagccucagaacggacgguguacaaccgauggcgugcuccuggggacgacacaacugagccccgucaauauuugcaccuuucgcggagacgugacacauaucaccggcucuagaaacuacaccaugaaucucgcuucccagaacuggaauaacuaugauccuacagaggaaacgcccgcgccucugggcacccccgacuucgucgggaaaauccagggaaugcuuacacagaccacacggaccgacggcagcacgcgcgggcacaaggccacaguguacaccggauccgcugauuuugccccgaagcugggcagaguucaauucgagaccgacacagaucaugacuuugaagccaaucagaacaccaaauucacaccugugggggucauucaggauggaucuacgacccaccggaaugagccccaacagugggugcuccccagcuacuccggccgcaacacacacaauguucaucuggcuccugccguggcgccgaccuuucccggcgaacagcuucuguucuuuagaagcacaaugccuggguguucuggauaucccaacauggaccucgauugccugcugccucaggaguggguccaauacuucuaucaggaggcugcccccgcccaguccgacguggcucuccugcgguuugugaauccugauaccggcagaguucuuuucgaauguaagcugcacaaaagcggguacgucacgguggcccauaccggacagcacgaccucgugauucccccgaacggcuauuuucgcuucgauucuugggucaaccaauucuacacacuggcuccuauggggaauggcaccggacggagacgcgugguuuga

SEQ ID NO: 27170 - RNA, 1623 nt, Artificial Sequence; identical to SEQ ID NO: 26674
  derived and/or modified sequence opt5 from VP1__Norovirus__AGS08092

SEQ ID NO: 27171 - RNA, 1623 nt, Artificial Sequence; identical to SEQ ID NO: 27129
  derived and/or modified sequence opt5 from VP1__Norovirus__AGS08093

SEQ ID NO: 27172 - RNA, 1623 nt, Artificial Sequence; identical to SEQ ID NO: 26522
  derived and/or modified sequence opt5 from VP1__Norovirus__AGS08094

SEQ ID NO: 27173 - RNA, 1623 nt, Artificial Sequence; identical to SEQ ID NO: 26522
  derived and/or modified sequence opt5 from VP1__Norovirus__AGS08095

SEQ ID NO: 27174 - RNA, 1623 nt, Artificial Sequence; identical to SEQ ID NO: 27137
  derived and/or modified sequence opt5 from VP1__Norovirus__AGS08096

SEQ ID NO: 27175 - RNA, 1623 nt, Artificial Sequence
  derived and/or modified sequence opt5 from VP1__Norovirus__AGS08097
augaagauggccagcuccgacgcuaaccccucugauggcagcaccgccaaucuggugccugaggucaacaaugaaguuauggcgcucgagccgguggugggggcugccaucgccgcucccgucgccggacagcaaaacauuaucgacccuuggauuagaaauaacuucgugcaggcucccggcggggaauuuacaguuuccccucggaaugcccccggagagauccuguggucugcgccucuuggcccggaucugaaccccuaccucagccaccuggcccgcauguauaauggguacgcuggaggcuucgaagugcaggucauucuugccggcaacgcuuuuacggccgggaaaaucaucuucgcggccgugccucccaauuuuccuaccgagggacugucccccucucagguuacaauguucccgcauauuaucguggacgucagacaacucgagccugugcugauuccccugccugaugugcggaacaauuuuuaucacuacaaccagagcaaugacuccaccaucaagcucauugcuaugcuguauacaccccuucgcgccaacaacgcuggcgaugacgucuucaccguuagcugcagagugcugacacggcccucuccugauuuugacuucaucuuucucgugccgcccaccgucgaaucccgcacgaaaccuuucagcgugcccguucugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucuccggcagcagaaacuacaccaugaaucucgccucccagaacuggaacucuuaugauccuaccgaggaaauucccgcuccucugggcacacccgacuucguggggaaaauccagggaguccuuacgcagaccacacggaccgacggcagcacacgcgggcacaaggcgaccguguacacgggauccgccgauuuuagcccgaagcugggcagaguucaauucgcuacagacaccgauaaugacuuugugaccaaucagaacacaaaauucaccccugucggggugauucaggauggaucuacaacgccccggaaugagccccaacaguggguucucccuuccuacagcggccgcaacacccauaaugugcaccuggccccggccgucgcucccacauuuccuggcgaacagcuucuguucuuuagaucuaccaugcccggguguagcggauauccuaacauggaccucgauugccugcugccccaggagugggugcaauacuucuaucaggaagccgcgccugcucaguccgacguggcccuccugcgguuuguuaaucccgauacaggcagaguccuuuucgaguguaagcugcacaaaucuggguacgugaccguggcccauacgggacagcacgaccucgucaucccgccuaacggcuauuuucgcuucgauagcugggugaaccaauucuacacccuggcucccauggggaauggcacaggacggagacgcgcccuuuga

SEQ ID NO: 27176 - RNA, 1623 nt, Artificial Sequence
  derived and/or modified sequence opt5 from VP1__Norovirus__AGS08098
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcucccacaacuacaccaugaaucucgccagccagaacuggaacuccuaugaucccaccgaggaaaucccugcuccccugggcacaccggacuucgucgggaaaauucagggagugcuuacgcagaccacaagaaccgacggcucuacacgggggcauaaggcgaccguuuacacgggaagcgccgauuuuuccccuaagcugggccgcgugcaauucgcuacagacaccgauaaugacuuugucaccaaucagaacacaaaauucacccccguggggguuauccaggauggaagcacaacgcccagaaaugagccucaacagugggugcucccgucuuacuccggccggaacacccacaauguccaccuggcccccgccguggcuccuacauuucccggcgaacagcuucuguucuuucgcagcaccaugccuggguguucuggauaucccaacauggaccucgauugccugcugccucaggagugggugcaauacuucuaucaggaagccgcgcccgcucagagcgacguugcccuccugagauuugucaauccggauacaggccgggugcuuuucgaguguaagcugcauaaauccggguacgugaccgucgcccacacgggacagcaugaccucgugauuccucccaacggcuauuuuagauucgauucuuggguuaaccaauucuacacccuggcuccuauggggaauggcacaggacgccggagagcccuuuga

SEQ ID NO: 27177 - RNA, 1623 nt, Artificial Sequence; identical to SEQ ID NO: 26674
  derived and/or modified sequence opt5 from VP1__Norovirus__AGS08099

SEQ ID NO: 27178 - RNA, 1623 nt, Artificial Sequence
  derived and/or modified sequence opt5 from VP1__Norovirus__AGS08100
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgucagccagaacuggaacuccuaugaucccaccgaggaaaucccugcuccccugggcacaccggacuucguggggaaaauucagggaguucuuacgcagaccacacggaccaauggcucuacacgcgggcacaaggccaccguguacacgggaagcgcggacuuuuccccuaagcugggcagaguccaauucgccacagauaccgacaaugauuuugagaccaaccagaauacaaaauucacccccguggggguuauccaggacggaagcacaacgccccggaacgaaccucaacagugggugcucccgucuuacuccggccgcaauauucauaacguccaccuggcucccgccguggccccuaccuuucccggcgagcagcuucuguucuuuagaagcacaaugccuggguguucuggauaucccaauauggaucucgacugccugcugccucaggaaugggugcaauacuucuaucaggaggcugcccccgcgcagagcgauguugcucuccugcgguuugucaacccggacaccggcagagugcuuuucgaguguaagcugcacaaauccggguacgugacagucgcccauaccggacagcacgaucucgugaucccucccaacggcuauuuucgcuucgacucuuggguuaaucaauucuacacgcuggccccuauggggaacggcaccggacggagacgcgcucuuuga

SEQ ID NO: 27179 - RNA, 1623 nt, Artificial Sequence
  derived and/or modified sequence opt5 from VP1__Norovirus__AGS08101
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucuccggcagcagaaacuacacaaugaaucucgcuucccagaacuggaacucuuaugauccuaccgaggaaauccccgcgccucugggcacccccgacuucgucgggaaaauucagggagugcuuacacagacgacccggacagacggcagcacccgcgggcacaaggccacaguuuacaccggauccgcugauuuuagcccgaagcugggcagagugcaauucgccacggacacagauaaugacuuuaucaccaaucagaacaccaaauucacaccugucggggugauucaggauggaucuaccacaccccggaaugagccccaacaguggguucucccuuccuacagcggccgcaacacgcauaaugugcaccuggccccggcugucgcccccaccuuuccuggcgaacagcuucuguucuuuagaucuacaaugcccggguguagcggauauccuaacauggaccucgauugccugcugccccaggagugggugcaauacuucuaucaggaagcggcuccugcccaguccgacguggcccuccugcgguuuguuaaucccgauaccggcagaguccuuuucgaguguaagcugcacaaaccgggguacgugacaguggcucauaccggacagcacgaccucgucaucccucccaacggcuauuuucgcuucgauucuugggugaaccaauucuacacgcuggccccuauggggaauggcaccggacggagacgcgcucuuuga

SEQ ID NO: 27180 - RNA, 1623 nt, Artificial Sequence; identical to SEQ ID NO: 27085
  derived and/or modified sequence opt5 from VP1__Norovirus__AGS08102

SEQ ID NO: 27181 - RNA, 1623 nt, Artificial Sequence
  derived and/or modified sequence opt5 from VP1__Norovirus__AGS08103
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacaucucuggcuccagaaauuacaccaugaaccucgccagccagaauuggaacuccuaugaucccaccgaggaaaucccugcuccccugggcacaccggacuucgucgggaaaauucagggagugcuuacgcagaccacacggaccgacggcucuacacgcgggcauaaggcgaccguuuacacgggaagcgccgauuuuuccccuaagcugggcagagugcaauucgcuacagacaccgauaaugacuuugucaccaaccagaauacaaaauucacccccguggggguuauccaggauggaagcacaacgccccggaacgagccucaacagugggugcucccgucuuacuccggccgcaauacccacaacguccaccuggcccccgccguggcuccuacauuucccggcgaacagcuucuguucuuuagaagcaccaugccuggguguucuggauaucccaauauggaccucgauugccugcugccucaggagugggugcaauacuucuaucaggaagccgcgcccgcucagagcgacguugcccuccugcgguuugucaacccggauacaggcagagugcuuuucgaguguaagcugcauaaauccggguacgugaccgucgcccacacgggacagcaugaccucgugauuccucccaauggcuauuuucgcuucgauucuuggguuaaccaauucuacacccuggcuccuauggggaacggcacaggacggagacgcgcccuuuga

SEQ ID NO: 27182 - RNA, 1623 nt, Artificial Sequence; identical to SEQ ID NO: 27175
  derived and/or modified sequence opt5 from VP1__Norovirus__AGS08104

SEQ ID NO: 27183 - RNA, 1623 nt, Artificial Sequence; identical to SEQ ID NO: 27141
  derived and/or modified sequence opt5 from VP1__Norovirus__AGS08105

SEQ ID NO: 27184 - RNA, 1623 nt, Artificial Sequence; identical to SEQ ID NO: 27160
  derived and/or modified sequence opt5 from VP1__Norovirus__AGS08106

SEQ ID NO: 27185 - RNA, 1623 nt, Artificial Sequence; identical to SEQ ID NO: 27129
  derived and/or modified sequence opt5 from VP1__Norovirus__AGS08107

SEQ ID NO: 27186 - RNA, 1623 nt, Artificial Sequence
  derived and/or modified sequence opt5 from VP1__Norovirus__AGS08108
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacugguccucuuaugaucccaccgaggaaaucccugcuccccugggcacaccggacuucgucgggaaaauucagggagugcuuacgcagaccacacggaccgacggcagcacacgcgggcacaaggcgaccguuuacacgggauccgccgauuuuagcccuaagcugggcagagugcaauucgcuacagacaccgauaaugacuuugucaccaaccagaauacaaaauucacccccguggggguuauccaggauggaucuacaacgccccggaacgagccucaacagugggugcucccguccuacagcggccgcaauacccauaacguccaccuggcccccgccguggcuccuacauuucccggcgaacagcuucuguucuuuagaucuaccaugccuggguguagcggauaucccaauauggaccucgauugccugcugccucaggagugggugcaauacuucuaucaggaagccgcgcccgcucaguccgacguugcccuccugcgguuugucaacccggauacaggcagagugcuuuucgaguguaagcugcacaaaucuggguacgugaccgucgcccauacgggacagcacgaccucgugauuccucccaauggcuauuuucgcuucgauagcuggguuaaccaauucuacacccuggcuccuauggggaacggcacaggacggagacgcgcccuuuga

SEQ ID NO: 27187 - RNA, 1623 nt, Artificial Sequence
  derived and/or modified sequence opt5 from VP1__Norovirus__AGS08109
augaagauggccagcuccgacgcuaaccccucugauggcagcgccgcgaaucuggugccugaggucaacaaugaaguuauggcucucgagccgguggccggggccgcuaucgccgcucccguggccggacagcaaaacgucauugacccuuggaucagaaauaacuucgugcaggcgcccggcggggaauuuaccguuuccccucggaaugcccccggagagauucuguggucugcuccucuuggcccggaucugaaccccuaccucagccaccuggcccgcauguauaauggguacgcuggaggcuucgaagugcaggucauccuugccggcaacgcguuuacagccgggaaagugauuuucgcugccguuccucccaauuuuccuacggagggacugucccccucucaggugaccauguucccgcauaucgucguggacgugagacaacucgagccuguccugaucccccugccugauguucggaacaauuuuuaucacuacaaccagagcaaugacuccacaauuaagcucaucgcuaugcuguauacaccccuucgcgccaacaacgccggcgaugacguguucaccgugagcugcagaguccugacccggcccucuccugauuuugacuucauuuuucucgugccgcccacaguugaaucccgcaccaaaccuuucagcgugcccguccugacgguggaggaaaugaccaauucuagauuuccuaucccccuugagaagcuguucacagggccguccagcgcuuucguugugcagccucagaacggacgguguaccacagauggcguccuccuggggaccacgcaacugucucccgugaauauuugcacauuucgcggagacgucacccauaucacaggcuccagaaacuacaccaugaaucucgcgagccagaacuggaauaacuaugauccuaccgaggaaauucccgccccucugggcacacccgacuucguggggaaaauccagggaaugcuuacgcagaccacacggaccgacggcuccacacgcgggcacaaggcuaccguuuacacgggaucugccgauuuugccccgaagcugggcagagugcaauucgagacagacaccgaucaugacuuugaagcuaaucagaacaccaaauucacaccugucggggugauccaggauggaagcaccacacaccggaaugagccccaacaguggguucuccccuccuacagcggccgcaacacgcacaaugugcaucuggccccugcggucgcuccgaccuuucccggcgaacagcuucuguucuuuagaucuacaaugccuggguguuccggauaucccaacauggaccucgauugccugcugccucaggagugggugcaauacuucuaucaggaggccgcccccgcucagagcgacguggcccuccugcgguuuguuaauccugauaccggcagaguccuuuucgaauguaagcugcacaaaucuggguacgugacaguggcucauaccggacagcacgaccucgucauucccccgaacggcuauuuucgcuucgauagcugggugaaccaauucuacacgcuggccccuauggggaauggcaccggacggagacgcguuguguga

SEQ ID NO: 27188 - RNA, 1623 nt, Artificial Sequence
  derived and/or modified sequence opt5 from VP1__Norovirus__AGS08110
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcucccacaacuacaccaugaaucucgccagccagaacuggaacuccuaugaucccaccgaggaaaucccugcuccccugggcacaccggacuucgucgggaaaauucagggagugcuuacgcagaccacaucuaccaauggcagcacaagagggcauaaggcgaccguuuacacgggauccgccgacuuuagcccuaagcugggccgggugcaauucgcuacagauaccaauaacgacuuugagaccaaucagaacacaaaauucacccccgucggggugauccaggauggaucuacaacgccccgcaaugaaccucaacaguggguucucccguccuacagcggcagaaacauucacaaugugcaccuggcccccgccgucgcuccuaccuuucccggcgagcagcuucuguucuuucggucuacaaugccuggguguagcggauaucccaacauggaccucgauugccugcugccucaggaaugggugcaauacuucuaucaggaggccgcgcccgcucaguccgacguggcccuccugcgcuuuguuaacccggauaccggcagaguccuuuucgaguguaagcugcauaaaucuggguacgugacaguggcccacaccggacagcaugaccucgucaucccucccaauggcuauuuucgguucgauagcugggugaaccaauucuacacgcuggcuccuauggggaauggcaccggaagacgccgggcccuuuga

SEQ ID NO: 27189 - RNA, 1623 nt, Artificial Sequence
  derived and/or modified sequence opt5 from VP1__Norovirus__AGS08111
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacaguaugaucucgucauucccccuaacggcuacuuucgcuucgacuccugggugaaucaauucuauacgcuggcucccauggggaacggcaccggacggagacgcgcccuuuga

SEQ ID NO: 27190 - RNA, 1623 nt, Artificial Sequence; identical to SEQ ID NO: 26674
  derived and/or modified sequence opt5 from VP1__Norovirus__AGS08112

SEQ ID NO: 27191 - RNA, 1623 nt, Artificial Sequence
  derived and/or modified sequence opt5 from VP1__Norovirus__AGS08113
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaagcacaacgccccggaaugagccucaacagugggugcucccgucuuacuccggccgcaacacccauaauguccaccuggcccccgccguggcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguugcccuccugcgguuugucaauccggauacaggcagagugcuuuucgaguguaagcugcacaaauccggguacgugaccgucgcccauacgggacagcacgaccucgugauuccucccaacggcuauuuucgcuucgauucuuggguuaaccaauucuacacccuggcuccuauggggaauggcgccggacggagacgcgcucuuuga

SEQ ID NO: 27192 - RNA, 1623 nt, Artificial Sequence; identical to SEQ ID NO: 27129
  derived and/or modified sequence opt5 from VP1__Norovirus__AGS08114

SEQ ID NO: 27193 - RNA, 1623 nt, Artificial Sequence; identical to SEQ ID NO: 26674
  derived and/or modified sequence opt5 from VP1__Norovirus__AGS08115

SEQ ID NO: 27194 - RNA, 1623 nt, Artificial Sequence; identical to SEQ ID NO: 27120
  derived and/or modified sequence opt5 from VP1__Norovirus__AGS08116

SEQ ID NO: 27195 - RNA, 1623 nt, Artificial Sequence
  derived and/or modified sequence opt5 from VP1__Norovirus__AGS08117
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggaaugcuuacgcagaccacacggaccgacggcucuacacgcgggcacaaggcgaccguguacacgggaagcgccgauuuuuccccuaagcugggcagaguucaauucgcuacagacaccgauaaugacuuugugaccaaucagaacacaaaauucacccccgucggggugauccaggauggaagcacaacgccccggaaugagccucaacaguggguucucccgucuuacuccggccgcaacacccauaaugugcaccuggcccccgccgucgcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguggcccuccugcgguuuguuaauccggauacaggcagaguccuuuucgaguguaagcugcacaaauccggguacgugaccguggcccauacgggacagcacgaccucgucauuccucccaacggcuauuuucgcuucgauucuugggugaaccaauucuacacccuggcuccuauggggaauggcacaggacggagacgcgcccuuuga

SEQ ID NO: 27196 - RNA, 1623 nt, Artificial Sequence; identical to SEQ ID NO: 27129
  derived and/or modified sequence opt5 from VP1__Norovirus__AGS08119

SEQ ID NO: 27197 - RNA, 1623 nt, Artificial Sequence; identical to SEQ ID NO: 27175
  derived and/or modified sequence opt5 from VP1__Norovirus__AGS08120

SEQ ID NO: 27198 - RNA, 1623 nt, Artificial Sequence; identical to SEQ ID NO: 27129
  derived and/or modified sequence opt5 from VP1__Norovirus__AGS08121

SEQ ID NO: 27199 - RNA, 1623 nt, Artificial Sequence
  derived and/or modified sequence opt5 from VP1__Norovirus__AGS08122
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugucaccaaucagaacacaaaauucacccccguggggguuauccaggauggaaauacaacgccccggaacgagccucaacagugggugcucccgagcuacucuggccgcaauacccauaacguccaccuggcccccgccguggcuccuacauuucccggcgaacagcuucuguucuuuagauccaccaugccuggguguagcggauaucccaauauggaccucgauugccugcugccucaggagugggugcaauacuucuaucaggaagccgcgcccgcucagucugacguugcccuccugcgguuugucaacccggauacaggcagagugcuuuucgaguguaagcugcacaaaccuggguacgugaccgucgcccauacgggacagcacgaccucgugauucccccuaacggcuauuuucgcuucgauagcuggguuaaucaauucuacacccuggcucccauggggaacggcacaggacggagacgcgcccuuuga

SEQ ID NO: 27200 - RNA, 1623 nt, Artificial Sequence
  derived and/or modified sequence opt5 from VP1__Norovirus__AGS08124
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuggagccuucgugguucagccccagaacggccgguguacaaccgauggggugcuccugggaacgacacaacuguccccugucaauauuugcaccuuucgcggcgacgugacacauaucagcggcucuagaaacuacaccaugaaucucgccucccagaacuggaauagcuaugaucccaccgaggaaaucccugcuccccuggggacaccggacuucgucggaaaaauucagggcgugcuuacgcagaccacacggaccgacggguccacacgcggacacaaggcgaccguuuacacgggcucugccgauuuuagcccuaagcuggggagagugcaauucgcuacagacaccgauuccgacuuugucaccaaccagaauacaaaauucacccccgugggaguuauccaggauggcagcacaacgccccggaacgagccucaacagugggugcucccgucuuacuccggccgcagcacccauaauguccaccuggcccccgccguggcuccuacauuucccggggaacagcuucuguucuuuagaucuaccaugccuggauguagcggcuaucccaacauggaccucgauugccugcugccucaggagugggugcaauacuucuaucaggaagccgcgcccgcucaguccgacguugcccuccugcgguuugucaauccggauacagggagagugcuuuucgaguguaagcugcacaaaucuggauacgugaccgucgcccauacgggccagcacgaccucgugauuccucccaacggguauuuucgcuucgauagcuggguuaaucaauucuacacccuggcuccuaugggcaacggaacaggccggagacgcgcccuuuga

SEQ ID NO: 27201 - RNA, 1623 nt, Artificial Sequence
  derived and/or modified sequence opt5 from VP1__Norovirus__AGS08125
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuguguuugccccuaagcugggcagaguucaauucgagacagauaccgaccaugauuuugaagccaaccagaauaccaaauucacacccgugggggucauccaggacggaagcaccacacaccggaacgagccccaacagugggugcucccuuccuacagcggccgcaauacgccgaacgugcaccuggcucccgccguugcgccuaccuuucccggcgaacagcuucuguucuuuagaucuacaaugccuggguguuccggauaucccaauauggaucucgacugccugcugccucaggaguggguccaauacuucuaucaggaggcugcccccgcccagagcgauguggcucuccugcgguuugugaacccggacaccggcagaguccuuuucgaauguaagcugcauaaaucuggguacgugacaguugcccacaccggacagcaugaucucgugauuccucccaauggcuauuuucgcuucgacagcugggucaaccaauucuacacgcuggcuccuauggggaacggcaccggacggagacgcgcccuuuga

SEQ ID NO: 27202 - RNA, 1623 nt, Artificial Sequence; identical to SEQ ID NO: 27139
  derived and/or modified sequence opt5 from VP1__Norovirus__AGS08126

SEQ ID NO: 27203 - RNA, 1623 nt, Artificial Sequence; identical to SEQ ID NO: 26674
  derived and/or modified sequence opt5 from VP1__Norovirus__AGS08127

SEQ ID NO: 27204 - RNA, 1623 nt, Artificial Sequence
  derived and/or modified sequence opt5 from VP1__Norovirus__AGS08128
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccgacggcuccacacgcgggcacaaggcgaccguuuacacgggaucugccgauuuuagccccaagcugggcagagugcaauucgcuacagacaccgauaacgacuuugucaccaaucagaacacaaaauucacccccguggggguuauccaggauggauccacaacgccucggaaugagccgcaacagugggugcuccccagcuacucuggccgcaacacccauaauguccaccuggccccugccguggcucccacauuuccuggcgaacagcuucuguucuuuagauccaccaugcccggguguagcggauauccuaacauggaccucgauugccugcugccccaggagugggugcaauacuucuaucaggaagccgcgccggcucagucugacguugcccuccugcgguuugucaauccugauacaggcagagugcuuuucgaguguaagcugcacaaaagcggguacgugaccgucgcccauacgggacagcacgaccucgugauucccccuaacggcuauuuucgcuucgauuccuggguuaaccaauucuacacccuggcucccauggggaauggcacaggacggagacgcgcccuuuga

SEQ ID NO: 27205 - RNA, 1623 nt, Artificial Sequence
  derived and/or modified sequence opt5 from VP1__Norovirus__AGS08129
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcucccacaacuacaccaugaaucucgccagccagaacuggaacuccuaugaucccaccgaggaaaucccugcuccccugggcacaccggacuucgucgggaaaauucagggaaugcuuacgcagaccacaagaaccgacggcucuacacgggggcauaaggcgaccguguacacgggaagcguugauuuuuccccuaagcugggccgcgugcaauucacaaccgacaccgauaaugacuuugagacaaaucagaacaccaaauucacacccgucggggugauccaggauggaagcacgacccacagaaaugaaccccaacaguggguucucccuucuuacuccggccggaacacacacaaugugcaucuggccccggcugucgcccccaccuuuccuggcgagcagcuucuguucuuucgcagcacaaugcccggguguucuggauauccuaacauggaccucgauugccugcugccccaggaaugggugcaauacuucuaucaggaggccgcuccugcccagagcgacguggcgcuccugagauuuguuaaucccgauaccggccggguccuuuucgaguguaagcugcacaaauccggguacgugacgguggcucauaccggacagcacgaccucgucauuccgccuaacggcuauuuuagauucgauucuugggugaaccaauucuacacacuggcccccauggggaauggcaccggacgccggagagcccuuuga

SEQ ID NO: 27206 - RNA, 1623 nt, Artificial Sequence
  derived and/or modified sequence opt5 from VP1__Norovirus__AGS08130
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacgggcggacggcucuacccgcgggcacaaggccacaguuuacaccggaagcgcugauuuuuccccuaagcugggcagagugcaauucgccacggacacagauaaugacuuugucgccaaucagaacaccaaauucacccccguggggguuauccaggauggaagcacaacaccccggaaugagccucaacagugggugcucccgucuuacuccggccgcaacacccauaauguccaccuggcucccgccguggcgccuacguuucccggcgaacagcuucuguucuuuagaagcaccaugccuggguguucuggauaucccaacauggaccucgauugccugcugccucaggagugggugcaauacuucuaucaggaagcugcccccgcccagagcgacguugcucuccugcgguuugucaauccggauacaggcagagugcuuuucgaguguaagcugcacaaauccggguacgugaccgucgcccauacaggacagcacgaccucgugauuccucccaacggcuauuuucgcuucgauucuuggguuaaccaauucuacacccuggcuccuauggggaauggcacgggacggagacgcgcccuuuga

SEQ ID NO: 27207 - RNA, 1623 nt, Artificial Sequence
  derived and/or modified sequence opt5 from VP1__Norovirus__AGS08131
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggaaacgugacccauaucacaggcucuagaaauuacaccaugaaccucgcuucccagaauuggaacaauuaugaccccaccgaggaaauuccugcgccccugggcacaccggauuucguugggaaaauccagggagugcuuacgcagaccacacggaccgacggcagcacacgcgggcacaaggccaccgucuacaucggauccgcugacuuugccccuaagcugggcagagugcaauucgagacggauacagaccaugauuuugaagccaaccagaauaccaaauucacccccguuggggugauucaggacggaggcacaacccaccggaacgagccccaacaguggguccucccuucuuacagcggccgcaauacacacaacgugcaucuggcuccggccguggcgcccacguuuccuggggaacagcuucuguucuuuagauccaccaugcccggauguagcggcuauccuaauauggaucucgacugccugcugccccaggaguggguucaauacuucuaucaggaggcugccccugcccagucugaugucgcucuccugcgguuugugaaccccgacacagggagagugcuuuucgaauguaagcugcacaaauccggauacgucaccguggcccauacaggccagcacgaucucguuaucccgccuaacggguauuuucgcuucgacagcugggugaaucaauucuacacccuggcucccaugggcaacggaacgggccggagacgcgccgucuga

SEQ ID NO: 27208 - RNA, 1623 nt, Artificial Sequence
  derived and/or modified sequence opt5 from VP1__Norovirus__AGS08132
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcucccacaacuacaccaugaaucucgccagccagaacuggaacuccuaugaucccaccgaggaaaucccugcuccccugggcacaccggacuucgucgggaaaauucagggagugcuuacgcagaccacaagaaccgacggcucuacacgggggcauaaggcgaccguuuacacgggaagcgccgauuuuuccccuaagcugggccgcgugcaauucgcuacagacaccgauaaugacuuugagaccaaucagaacacaaaauucacccccgucggggugauccaggauggaggcacaacgcacagaaaugaaccccaacaguggguucucccuagcuacucuggccggaacauucacaaugugcaucuggccccggccgucgcucccaccuuuccuggggagcagcuucuguucuuucgcuccacaaugcccggauguagcggcuauccuaacauggaccucgauugccugcugccccaggaaugggugcaauacuucuaucaggaggccgcgccugcucagucugacguggcccuccugagauuuguuaaucccgauaccgggcggguccuuuucgaguguaagcugcacaaaagcggauacgugacaguggcccauaccggccagcacgaccucgucaucccgccuaacggguauuuuagauucgauuccugggugaaccaauucuacacgcuggcucccaugggcaauggaaccggccgccggagagcccuuuga

SEQ ID NO: 27209 - RNA, 1623 nt, Artificial Sequence
  derived and/or modified sequence opt5 from VP1__Norovirus__AGS08133
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccuccuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuucccaucccgcuugagaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgccucccagaauuggaacucuuaugaucccaccgaggaaaucccugcuccccugggcacaccggacuucgucgggaaaauucagggagugcuuacgcagaccacacggaccgacggcagcacacgcgggcacaaggcgaccguuuacacgggauccgccgauuuuagcccuaagcugggcagagugcaauucgcuacagacaccgauaaugacuuugucaccaaccagaauacaaaauucacccccguggggguuauccaggauggaucuacaacgccccggaacgagccucaacagugggugcucccguccuacagcggccgcaauacccauaacguccaccuggcccccgccguggcuccuacauuucccggcgaacagcuucuguucuuuagaucuaccaugccuggguguagcggauaucccaauauggaccucgauugccugcugccucaggagugggugcaauacuucuaucaggaagccgcgcccgcucaguccgacguugcccuccugcgguuugucaacccggauacaggcagagugcuuuucgaguguaagcugcacaaaucuggguacgugaccgucgcccauacgggacagcacgaccucgugauuccucccaauggcuauuuucgcuucgauagcuggguuaaccaauucuacacccuggcuccuauggggaacggcacaggacggagacgcgcccuuuga

SEQ ID NO: 27210 - RNA, 1623 nt, Artificial Sequence
  derived and/or modified sequence opt5 from VP1__Norovirus__AGS08134
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaaugucugcaccuuucgcggagacgugacacauaucccuggcucccacaacuacaccaugaaucucgccagccagaacuggaacuccuaugaucccaccgaggaaaucccugcuccccugggcacaccggacuucgucgggaaaauucagggagugcuuacgcagaccacaucuaccaauggcagcacaagagggcauaaggcgaccguuuacacgggauccgccgacuuuagcccuaagcugggccgggugcaauucgcuacagauaccaauaacgacuuugagaccaaucagaacacaaaauucacccccgucggggugauccaggauggaucuacaacgccccgcaaugaaccucaacaguggguucucccguccuacagcggcagaaacauucacaaugugcaccuggcccccgccgucgcuccuaccuuucccggcgagcagcuucuguucuuucggucuacaaugccuggguguagcggauaucccaacauggaccucgauugccugcugccucaggaaugggugcaauacuucuaucaggaggccgcgcccgcucaguccgacguggcccuccugcgcuuuguuaacccggauaccggcagaguccuuuucgaguguaagcugcauaaaucuggguacgugacaguggcccacaccggacagcaugaccucgucaucccucccaauggcuauuuucgguucgauagcugggugaaccaauucuacacgcuggcuccuauggggaauggcaccggaagacgccgggcccuuuga

SEQ ID NO: 27211 - RNA, 1623 nt, Artificial Sequence
  derived and/or modified sequence opt5 from VP1__Norovirus__AGS08135
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuucuggcuccagaaacuacaccaugaaucucgccagccagaacuggaacuccuaugaucccaccgaggaaaucccugcuccccugggcacaccggacuucguggggaaaauccagggaguucuuacgcagaccacacggaccgacggcucuacacgcgggcacaaggcgaccguguacacgggaagcgccgauuuuuccccuaagcugggcagaguccaauucgcuacagacaccgauaaugacuuugugaccaaucagaacacaaaauucacccccguuggggugauucaggauggaagcacaacgccccggaaugagccucaacaguggguccucccgucuuacuccggccgcaacacccauaaugugcaccuggcccccgccguggcuccuacauuucccggcgaacagcuucuguucuuuagaagcaccaugccuggguguucuggauaucccaacauggaccucgauugccugcugccucaggaguggguucaauacuucuaucaggaagccgcgcccgcucagagcgacgucgcccuccugcgguuugugaauccggauacaggcagagugcuuuucgaguguaagcugcacaaauccggguacgucaccguggcccauacgggacagcacgaccucguuaucccucccaacggcuauuuucgcuucgauucuugggugaaccaauucuacacccuggcuccuauggggaauggcacaggacggagacgcgcccuuuga

SEQ ID NO: 27212 - RNA, 1623 nt, Artificial Sequence; identical to SEQ ID NO: 27129
  derived and/or modified sequence opt5 from VP1__Norovirus__AGS08136

SEQ ID NO: 27213 - RNA, 1623 nt, Artificial Sequence
  derived and/or modified sequence opt5 from VP1__Norovirus__AGS08137
augaagauggccagcuccgacgcuaaccccucugauggcagcuccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuaccgugucuccucggaaugcccccggagagauucuguggagcgcgccucuuggcccggaucugaaccccuaccucucccaccuggcccgcauguauaauggguacgcuggaggcuucgaaguccaggugauccuugccggcaacgcuuuuacagccgggaaaauuaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccaguccaaugaccccacaauuaagcucaucgcuaugcuguauacaccccuucgcgccaacaacgcuggcgaugacguuuucaccgugagcugcagagugcugacccggccuucuccggauuuugacuucauuuuucucgugcccccuacagucgaaucccgcaccaaacccuucagcguuccugugcugacggucgaggaaaugaccaauucuagauuucccaucccgcuugagaagcuguucacagggccuuccagcgccuucgugguucagccccagaacggacgguguaccacagauggcgugcuccuggggaccacgcaacugucuccugucaauauuugcacauuucgcggagacgugacccauaucuccggcagcagaaacuacacaaugaaucucgccucccagaacuggaacucuuaugaucccaccgaggaaaucccugcuccccugggcaccccggacuucgucgggaaaauucagggagugcuuacacagacgacccggacagacggcagcacccgcgggcacaaggcgacaguuuacaccggauccgccgauuuuagcccuaagcugggcagagugcaauucgcuacggacacagauaaugacuuugucaccaaucagaacaccaaauucacacccguggggguuauccaggauggaucuaccacaccccggaaugagccucaacagugggugcucccguccuacagcggccgcaacacgcauaauguccaccuggcccccgccguggcuccuaccuuucccggcgaacagcuucuguucuuuagaucuacaaugccuggguguagcggauaucccaacauggaccucgauugccugcugccucaggagugggugcaauacuucuaucaggaagccgcgcccgcucaguccgacguugcccuccugcgguuugucaauccggauaccggcagagugcuuuucgaguguaagcugcacaaaucuggguacgugacagucgcccauaccggacagcacgaccucgugauuccucccaacggcuauuuucgcuucgauagcuggguuaaccaauucuacacgcuggcuccuauggggaauggcaccggacggaagagagcccuuuga

SEQ ID NO: 27214 - RNA, 1623 nt, Artificial Sequence; identical to SEQ ID NO: 27150
  derived and/or modified sequence opt5 from VP1__Norovirus__AGS08138

SEQ ID NO: 27215 - RNA, 1623 nt, Artificial Sequence
  derived and/or modified sequence opt5 from VP1__Norovirus__AGS08139
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauucccgcgccucugggcacacccgacuucguugggaaaauccagggaaugcuuacgcagaccacacggaccgacggcuccacacgcgggcacaaggccaccguguacacgggaucugcugauuuugccccgaagcugggcagaguccaauucgagacagacaccgaucaugacuuugaagccaaucagaacaccaaauucacaccuguggggguuauccaggauggaagcaccacacaccggaaugagccccaacagugggugcuccccuccuacagcggccgcaacacgcacaauguccaucuggcuccugccguggcgccgaccuuucccggcgaacagcuucuguucuuuagaucuacaaugccuggguguuccggauaucccaacauggaccucgauugccugcugccucaggagugggugcaauacuucuaucaggaggcugcccccgcccagagcgacguugcucuccugcgguuugucaauccugauaccggcagagugcuuuucgaauguaagcugcacaaaucuggguacgugacagucgcccauaccggacagcacgaccucgugauucccccgaacggcuauuuucgcuucgauagcuggguuaaccaauucuacacgcuggcuccuauggggaauggcaccggacggagacgcguggucuga

SEQ ID NO: 27216 - RNA, 1623 nt, Artificial Sequence
  derived and/or modified sequence opt5 from VP1__Norovirus__AGS08140
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaggcaccacacaccggaaugagccccaacagugggugcuccccagcuacuccggccgcaacacgcacaauguucaucuggcuccugccguggcgccgaccuuucccggggaacagcuucuguucuuuagaagcacaaugccuggauguucuggcuaucccaacauggaccucgauugccugcugccucaggaguggguccaauacuucuaucaggaggcugcccccgcccaguccgacguggcucuccugcgguuugugaauccugauaccgggagaguucuuuucgaauguaagcugcacaaaagcggauacgucacaguggcccauaccggccagcacgaccucgugauucccccgaacggguauuuucgcuucgauucuugggucaaccaauucuacacgcuggcuccuaugggcaauggaaccggccggagacgcgugguuuga

SEQ ID NO: 27217 - RNA, 1623 nt, Artificial Sequence
  derived and/or modified sequence opt5 from VP1__Norovirus__AGS08141
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccggacagacggcagcacccgcgggcacaaggcuacaguguacaccggauccgccgauuuugccccuaagcugggcagaguccaauucgagacggacacagaucaugacuuugaagcuaaucagaacaccaaauucacccccguggggguuauccaggauggaucuacaacccaccggaaugagccccaacagugggugcucccuagcuacuccggccgcaacacacacaauguccaucuggccccggcgguggcucccacguuuccuggcgaacagcuucuguucuuuagaagcaccaugcccggguguucuggauauccuaacauggaccucgauugccugcugccccaggagugggugcaauacuucuaucaggaggccgccccugcucaguccgacguugcccuccugcgguuugucaaucccgauacaggcagagugcuuuucgaauguaagcugcacaaaagcggguacgugaccgucgcucauacaggacagcacgaccucgugauuccgccuaacggcuauuuucgcuucgauucuuggguuaaccaauucuacacccuggcccccauggggaauggcacgggacggagacgcguggucuga

SEQ ID NO: 27218 - RNA, 1623 nt, Artificial Sequence
  derived and/or modified sequence opt5 from VP1__Norovirus__AGS08142
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcgccaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggagcaauuaugaucccaccgaggaaauuccugcuccccugggcaccccggacuucguugggaaaauccagggagugcuuacacagacgacccggacagacggcuccacccgcgggcacaaggccacagucuacaccggaucugccgauuuugccccuaagcugggcagagugcaauucgagacggacacagaucaugacuuugaagcuaaccagaauaccaaauucacccccguuggggugauccaggauggaagcacaacccaccggaacgagccccaacaguggguccucccuuccuacagcggccgcaauacaccgaacgugcaccuggcccccgcgguggcuccuacguuucccggcgaacagcuucuguucuuuagaucuaccaugccuggguguuccggauaucccaauauggaccucgauugccugcugccucaggaguggguucaauacuucuaucaggaggccgcccccgcucagagcgacgucgcccuccugcgguuugugaacccggauacaggcagagugcuuuucgaauguaagcugcauaaaucuggguacgucaccguggcucacacaggacagcaugaccucguuauuccucccaauggcuauuuucgcuucgauagcugggugaaccaauucuacacccuggccccuauggggaacggcacgggacggagacgcgcgcccuga

SEQ ID NO: 27219 - RNA, 1623 nt, Artificial Sequence; identical to SEQ ID NO: 26482
  derived and/or modified sequence opt5 from VP1__Norovirus__AGS08143

SEQ ID NO: 27220 - RNA, 1623 nt, Artificial Sequence
  derived and/or modified sequence opt5 from VP1__Norovirus__AGS08144
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaacccggguacgugacaguggcccauaccggacagcacgaucucgucaucccucccaacggcuauuuucgcuucgacagcugggugaaucaauucuacacgcuggcuccgauggggaacggcaccggacggagacgcgcccuuuga

SEQ ID NO: 27221 - RNA, 1623 nt, Artificial Sequence
  derived and/or modified sequence opt5 from VP1__Norovirus__AGS08145
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucccuggcucccacaacuacaccaugaaucucgccagccagaacuggaacuccuaugaucccaccgaggaaaccccugcuccccugggcacgccggacuucguggggaaaauucagggaguccuuacccagacaaccucuacaaauggcagcaccagagggcauaaggcgacgguguacacaggauccgccgacuuuagcccuaagcugggccggguucaauucgcuaccgauaccaauaacgacuuugagacaaaucagaacaccaaauucacacccgugggggucauccaggauggaucuacgacaccccgcaaugaaccucaacagugggugcucccguccuacagcggcagaaacauucacaauguucaccuggcccccgccguggcuccuacauuucccggcgagcagcuucuguucuuucggucuaccaugccuggguguagcggauaucccaacauggaccucgauugccugcugccucaggaauggguccaauacuucuaucaggaggccgcgcccgcucaguccgacguggcccuccugcgcuuugugaacccggauacaggcagaguucuuuucgaguguaagcugcauaaaucuggguacgucaccguggcccacacgggacagcaugaccucgugaucccucccaauggcuauuuucgguucgauagcugggucaaccaauucuacacccuggcuccuauggggaauggcacaggaagacgccgggcccuuuga

SEQ ID NO: 27222 - RNA, 1623 nt, Artificial Sequence; identical to SEQ ID NO: 27181
  derived and/or modified sequence opt5 from VP1__Norovirus__AGS08146

SEQ ID NO: 27223 - RNA, 1623 nt, Artificial Sequence; identical to SEQ ID NO: 26522
  derived and/or modified sequence opt5 from VP1__Norovirus__AGS08147

SEQ ID NO: 27224 - RNA, 1623 nt, Artificial Sequence; identical to SEQ ID NO: 27129
  derived and/or modified sequence opt5 from VP1__Norovirus__AGS08148

SEQ ID NO: 27225 - RNA, 1623 nt, Artificial Sequence
  derived and/or modified sequence opt5 from VP1__Norovirus__AGS08149
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggaacgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggaaaauguacaaccgauggcgugcuccuggggacgacacaacuguccccugucaacauuugcaccuuucggggagacgugacacauauccccggcagccgcaauuacaccaugaaccucgccucucagaauuggaacuccuaugauccuaccgaggaaauccccgcuccgcugggcacaccugacuucgucgggaagauucagggagugcuuacgcagaccacaagaaccaauggcagcacacgggggcacaaggcgaccguuuacacgggauccgccgacuuuucucccaaacugggccgcgugcaauucgcuacagauaccgacaacgauuuugagaccaaucagaacacaaaguucacccccgucggggugauccaggacggaagcacaacgccuagaaaugaaccgcaacaguggguucuccccuccuacagcggccggaacauucauaaugugcaccuggccccugccgucgcucccaccuuuccuggcgagcagcuucuguucuuucgcucuacaaugcccggguguuccggauauccuaacauggaucucgacugccugcugccccaggaaugggugcaauacuucuaucaggaggccgcgccggcucagagcgauguggcccuccugagauuuguuaacccugacaccggccggguccuuuucgaguguaaacugcacaagucuggguacgugacaguggcccauaccggacagcacgaucucgucauucccccuaauggcuauuuuagauucgacagcugggugaaccaauucuacacgcuggcucccauggggaauggcaccggacgccggagagcccuuuga

SEQ ID NO: 27226 - RNA, 1623 nt, Artificial Sequence; identical to SEQ ID NO: 27175
  derived and/or modified sequence opt5 from VP1__Norovirus__AGS08150

SEQ ID NO: 27227 - RNA, 1623 nt, Artificial Sequence
  derived and/or modified sequence opt5 from VP1__Norovirus__AGS08152
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccgugccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucucacaacuacaccaugaaucucgcuucccagaacuggaauagcuaugaucccaccgaggaaaucccugcgccccugggcacaccggacuucguggggaaaauccagggaguucuuacgcagaccacaagagccaacggcuccacccgggggcauaaggcuacaguguacaccggaucugccgacuuugccccuaagcugggccgcguccaauucgcuacggauacaaauaacgacuuugaugccaaucagaacaccaaauucacccccguggggguuauucaggacggagauacagcgcacagaaaugagccccaacagugggugcucccuagcuacuccggccggaacagccacaauguccaucuggcuccggccguggcccccaccuuuccuggcgaacagcuucuguucuuucgcucuacaaugcccggguguuccggauauccuaacauggaccucgauugccugcugccccaggagugggugcaauacuucuaucaggaagcugccccugcucagagcgacguugcccuccugagauuugucaaccccgauacgggccgggugcuuuucgaguguaagcugcacaaaucuggguacgugaccgucgcgcauacaggacagcacgaccucgugaucccgccuaauggcuauuuuagauucgauagcuggguuaaccaauucuacacccuggcccccauggggaauggcacaggacgccggagagcucuuuga

SEQ ID NO: 27228 - RNA, 1623 nt, Artificial Sequence
  derived and/or modified sequence opt5 from VP1__Norovirus__AGS08153
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccgugccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucucacaacuacaccaugaaucucgcuucccagaacuggaauagcuaugaucccaccgaggaaaucccugcgccccugggcacaccggacuucguggggaaaauccagggaguucuuacgcagaccacaagagccgacggcuccacccgggggcauaaggcuacaguguacaccggaucugccgauuuugccccuaagcugggccgcguccaauucgcuacggacacaaacaaugauuuugacgccaaccagaauaccaaauucacccccguggggguuauucaggauggagacacagcgcacagaaacgagccccaacagugggugcucccuagcuacuccggccggaauagccacaacguccaucuggcuccggccguggcccccaccuuuccuggcgaacagcuucuguucuuucgcucuacaaugcccggguguuccggauauccuaauauggaucucgacugccugcugccccaggagugggugcaauacuucuaucaggaagcugccccugcucagagcgauguugcccuccugagauuugucaaccccgacacgggccgggugcuuuucgaguguaagcugcacaaaucuggguacgugaccgucgcgcauacaggacagcacgaucucgugaucccgccuaacggcuauuuuagauucgacagcuggguuaaucaauucuacacccuggcccccauggggaacggcacaggacgccggagagcucuuuga

SEQ ID NO: 27229 - RNA, 1623 nt, Artificial Sequence
  derived and/or modified sequence opt5 from VP1__Norovirus__AGS08154
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucgaggugauccuugcuggcaacgccuuuacagcggggaaaauuaucuucgccgcuguuccucccaauuuuccuacggagggacugucccccucucaggugaccauguucccgcauaucauugucgacgugagacagcucgaaccugugcugaucccccugccugauguccggaacaauuuuuaucacuacaaccaaagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggagucccgcaccaaaccuuucagcguucccgugcugacggucgaagagaugaccaauucuagauuuccuaucccccuugagaagcuguucacagggccguccagcgccuucgugguucagccucagaacggacgguguaccacagauggcgugcuccuggggaccacgcagcugucucccgucaauauuugcacauuucgcggagacgugacccauaucacaggcuccagaaacuacaccaugaaucucgcuagccaaaacuggaauaacuaugauccuaccgaagagauccccgcgccucugggcacacccgacuucgucgggaaaauucagggaacgcuuacccagacaacccggacagacggcuccacccgcgggcacaaggccacgguguacacaggaucugcugauuuugccccgaagcugggcagaguucaguucgaaaccgacaccgaucaugacuuugaggccaaucaaaacacaaaauucaccccugugggggucauccaggauggaagcacaacgcaccggaaugaaccccagcaaugggugcuccccuccuacagcggccgcaacacccacaauguucaucuggcuccugccguggcgccgacauuucccggcgagcagcuucuguucuuuagaucuaccaugccuggguguuccggauaucccaacauggaccucgauugccugcugccucaggaguggguccaguacuucuaucaagaagcugcccccgcccagagcgacguggcucuccugcgguuugugaauccugauacaggcagaguucuuuucgaguguaagcugcacaaaucuggguacgucaccguggcccauacgggacagcacgaccucgugauucccccgaacggcuauuuucgcuucgauagcugggucaaccaguucuacacccuggcuccuauggggaauggcacaggacggagacgcgugguuuga

SEQ ID NO: 27230 - RNA, 1623 nt, Artificial Sequence; identical to SEQ ID NO: 27137
  derived and/or modified sequence opt5 from VP1__Norovirus__AGS08157

SEQ ID NO: 27231 - RNA, 1623 nt, Artificial Sequence
  derived and/or modified sequence opt5 from VP1__Norovirus__AGS08158
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccagcacgaccucguuauuccgccuaacggguauuuucgcuucgauagcugggugaaccaauucuacacgcuggcucccaugggcaauggaaccggccggagacgcgucaucuga

SEQ ID NO: 27232 - RNA, 1623 nt, Artificial Sequence; identical to SEQ ID NO: 27141
  derived and/or modified sequence opt5 from VP1__Norovirus__AGS08160

SEQ ID NO: 27233 - RNA, 1623 nt, Artificial Sequence
  derived and/or modified sequence opt5 from VP1__Norovirus__AGS08161
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcgccguguga

SEQ ID NO: 27234 - RNA, 1623 nt, Artificial Sequence
  derived and/or modified sequence opt5 from VP1__Norovirus__AGS08162
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcgugguuuga

SEQ ID NO: 27235 - RNA, 1623 nt, Artificial Sequence; identical to SEQ ID NO: 27234
  derived and/or modified sequence opt5 from VP1__Norovirus__AGS08163

SEQ ID NO: 27236 - RNA, 1623 nt, Artificial Sequence; identical to SEQ ID NO: 27139
  derived and/or modified sequence opt5 from VP1__Norovirus__AGS08164

SEQ ID NO: 27237 - RNA, 1623 nt, Artificial Sequence
  derived and/or modified sequence opt5 from VP1__Norovirus__AGS08165
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucgaggugauccuugcuggcaacgccuuuacagcggggaaaauuaucuucgccgcuguuccucccaauuuuccuacggagggacugucccccucucaggugaccauguucccgcauaucauugucgacgugagacagcucgaaccugugcugaucccccugccugauguccggaacaauuuuuaucacuacaaccaaagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggagucccgcaccaaaccuuucagcguucccgugcugacggucgaagagaugaccaauucuagauuuccuaucccccuugagaagcuguucacagggccguccagcgccuucgugguucagccucagaacggacgguguaccacagauggcgugcuccuggggaccacgcagcugucucccgucaauauuugcacauuucgcggagacgugacccauaucacaggcuccagaaacuacaccaugaaucucgcuagccaaaacuggaauaacuaugauccuaccgaagagauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaguucgaaacagacaccgaucaugacuuugaggccaaucaaaacaccaaauucacaccugugggggucauccaggauggaagcaccacacaccggaaugaaccccagcaaugggugcuccccuccuacagcggccgcaacacgcacaauguucaucuggcuccugccguggcgccgaccuuucccggcgagcagcuucuguucuuuagaucuacaaugccuggguguuccggauaucccaacauggaccucgauugccugcugccucaggaguggguccaguacuucuaucaagaagcugcccccgcccagagcgacguggcucuccugcgguuugugaauccugauaccggcagaguucuuuucgaguguaagcugcacaaaucuggguacgucacaguggcccauaccggacagcacgaccucgugauucccccgaacggcuauuuucgcuucgauagcugggucaaccaguucuacacgcuggcuccuauggggaauggcaccggacggagacgcgugguuuga

SEQ ID NO: 27238 - RNA, 1623 nt, Artificial Sequence; identical to SEQ ID NO: 27234
  derived and/or modified sequence opt5 from VP1__Norovirus__AGS08166

SEQ ID NO: 27239 - RNA, 1623 nt, Artificial Sequence
  derived and/or modified sequence opt5 from VP1__Norovirus__AGS08167
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccaacgccuucgugguucagccucagaauggacgguguaccacagauggcgugcuccuggggaccacgcaacugagccccgucaacauuugcacauuucgcggagacgugacccauaucacaggcucuagaaauuacaccaugaaccucgcuucccagaauuggaacaauuaugauccuaccgaggaaauccccgcgccucugggcacacccgacuucgucgggaaaauucagggaaugcuuacgcagaccacacggaccgacggcagcacacgcgggcacaaggccaccguguacacgggauccgcugauuuugccccgaagcugggcagaguucaauucgagacagacaccgaucaugacuuugaagccaaccagaauaccaaauucacaccugugggggucauccaggauggaucuaccacacaccggaacgagccccaacagugggugcuccccagcuacuccggccgcaauacgcacaacguucaucuggcuccugccguggcgccgaccuuucccggcgaacagcuucuguucuuuagaagcacaaugccuggguguucuggauaucccaauauggaccucgauugccugcugccucaggaguggguccaauacuucuaucaggaggcugcccccgcccaguccgacguggcucuccugcgguuugugaacccugauaccggcagaguucuuuucgaauguaagcugcacaaaagcggguacgucacaguggcccauaccggacagcacgaccucgugauucccccgaacggcuauuuucgcuucgauucuugggucaaucaauucuacacgcuggcuccuauggggaacggcaccggacggagacgcgugguuuga

SEQ ID NO: 27240 - RNA, 1623 nt, Artificial Sequence; identical to SEQ ID NO: 27237
  derived and/or modified sequence opt5 from VP1__Norovirus__AGS08168

SEQ ID NO: 27241 - RNA, 1623 nt, Artificial Sequence
  derived and/or modified sequence opt5 from VP1__Norovirus__AGS08169
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauauucggaacaauuuuuaucacuacaaccagagcaaugacuccacaaucaagcucauugccaugcuguauacaccccuucgcgcuaacaacgccggcgaugacgucuucaccguuagcugcagagugcugacccggcccucuccugauuuugacuucaucuuucucgugccgcccacagucgaaucccgcaccaaaccuuucagcgugcccguucugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacgucacccauaucacaggcuccagaaacuacaccaugaaucucgcuagccagaacuggaauaacuaugauccuaccgaggaaauucccgcgccucugggcacacccgacuucguggggaaaauccagggaguccuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauucaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccuggguguuccggauaucccaacauggaccucgauugccugcugccucaggaguggguccaauacuucuaucaggaggcugcccccgcccagagcgacguggcucuccugcgguuugugaauccugauaccggcagaguucuuuucgaauguaagcugcacaaaucuggguacgucacaguggcccauaccggacagcacgaccucgugauucccccgaacggcuauuuucgcuucgauagcugggucaaccaauucuacacgcuggcuccuauggggaauggcaccggacggagacgcgugguuuga

SEQ ID NO: 27242 - RNA, 1623 nt, Artificial Sequence; identical to SEQ ID NO: 27234
  derived and/or modified sequence opt5 from VP1__Norovirus__AGS08170

SEQ ID NO: 27243 - RNA, 1623 nt, Artificial Sequence
  derived and/or modified sequence opt5 from VP1__Norovirus__AGS08171
augaagauggccagcuccgacgcuaaccccucugauggcagcgccgcgaaucuggugccugaggucaacaaugaaguuauggcucucgacccgguggugggggccgccaucgcugcccccgucgcuggacagcaaaacgugauugauccuuggaucagaaauaacuucguucaggcccccggcggggaguuuaccguguccccucggaaugcgcccggagaaauucuguggucugccccucuuggcccggaccugaaccccuaccucagccaccuggcucgcauguauaauggguacgccggaggcuucgagguccaggugauccuugcuggcaacgccuuuacagcggggaaaauuaucuucgccgcuguuccucccaauuuuccuacggaaggacugucccccucucaggugaccauguucccgcauaucauugucgaugugagacaacucgagccugugcugaucccccugccugacguccggaacaauuuuuaucacuacaaccagagcaaugauuccacaauuaagcucaucgccaugcuguauacaccccuucgcgcuaacaacgccggcgacgauguuuucaccgugagcugcagagugcugacccggcccucuccugacuuugauuucauuuuucucgucccgcccacaguggagucccgcaccaaaccuuucagcguucccgugcugacggucgaagagaugaccaauucuagauuuccuaucccccuugaaaagcuguucacagggccguccagcgccuucgugguucagccucagaacggacgguguaccacagacggcgugcuccuggggaccacgcaacugucucccgucaauauuugcacauuucgcggagaugugacccauaucacaggcuccagaaacuacaccaugaaucucgcuagccagaacuggaauaacuaugacccuaccgaggagauccccgcgccucugggcacacccgacuucgucgggaaaauucagggaaugcuuacgcagaccacacggaccgauggcuccacacgcgggcacaaggccaccguguacacgggaucugcugacuuugccccgaagcugggcagaguucaauucgaaacagauaccgaccaugauuuugaggccaaucagaacaccaaauucacaccugugggggucauccaggacggaagcaccacacaccggaaugaaccccaacagugggugcuccccuccuacagcggccgcaacacgcacaauguucaucuggcuccugccguggcgccgaccuuucccggcgagcagcuucuguucuuuagaucuacaaugccuggguguuccggauaucccaacauggaucucgacugccugcugccucaggaauggguccaauacuucuaucaggaggcugcccccgcccagagcgauguggcucuccugcgguuugugaauccugacaccggcagaguucuuuucgaguguaagcugcacaaaucuggguacgucacaguggcccauaccggacagcacgaucucgugauucccccgaacggcuauuuucgcuucgacagcugggucaaccaauucuacacgcuggcuccuauggggaauggcaccggacggagacgcgugguuuga

SEQ ID NO: 27244 - RNA, 1623 nt, Artificial Sequence; identical to SEQ ID NO: 27139
  derived and/or modified sequence opt5 from VP1__Norovirus__AGS08172

SEQ ID NO: 27245 - RNA, 1623 nt, Artificial Sequence; identical to SEQ ID NO: 27237
  derived and/or modified sequence opt5 from VP1__Norovirus__AGS08173

SEQ ID NO: 27246 - RNA, 1623 nt, Artificial Sequence; identical to SEQ ID NO: 27234
  derived and/or modified sequence opt5 from VP1__Norovirus__AGS08174

SEQ ID NO: 27247 - RNA, 1623 nt, Artificial Sequence; identical to SEQ ID NO: 27133
  derived and/or modified sequence opt5 from VP1__Norovirus__AGS08175

SEQ ID NO: 27248 - RNA, 1623 nt, Artificial Sequence; identical to SEQ ID NO: 27234
  derived and/or modified sequence opt5 from VP1__Norovirus__AGS08176

SEQ ID NO: 27249 - RNA, 1623 nt, Artificial Sequence; identical to SEQ ID NO: 27237
  derived and/or modified sequence opt5 from VP1__Norovirus__AGS08177

SEQ ID NO: 27250 - RNA, 1623 nt, Artificial Sequence; identical to SEQ ID NO: 27234
  derived and/or modified sequence opt5 from VP1__Norovirus__AGS08178

SEQ ID NO: 27251 - RNA, 1623 nt, Artificial Sequence; identical to SEQ ID NO: 27234
  derived and/or modified sequence opt5 from VP1__Norovirus__AGS08179

SEQ ID NO: 27252 - RNA, 1623 nt, Artificial Sequence; identical to SEQ ID NO: 27234
  derived and/or modified sequence opt5 from VP1__Norovirus__AGS08180

SEQ ID NO: 27253 - RNA, 1623 nt, Artificial Sequence; identical to SEQ ID NO: 27237
  derived and/or modified sequence opt5 from VP1__Norovirus__AGS08181

SEQ ID NO: 27254 - RNA, 1623 nt, Artificial Sequence; identical to SEQ ID NO: 27237
  derived and/or modified sequence opt5 from VP1__Norovirus__AGS08182

SEQ ID NO: 27255 - RNA, 1647 nt, Artificial Sequence
  derived and/or modified sequence opt5 from VP1__Norovirus__AGT39181
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgacuuuuccuucaauuuucuuguucccccuacaguggaaagcaagaccaaaccguucacgcugcccauucucaccaucucugagauguccaacagcagauuuccugugcccauugauucucugcauacauccccuaccgaaaauaucgucgugcagugccagaacggacggguuacacuggacggcgagcucauggggaccacgcaacugcuucccagccagaucugugcuuuccgcggagugcugacaagaucuaccucccgggcgagcgaucaggccgacacagcuaccccgcgccucuucaauuauuacuggcacauucagcuggacaaccuuaauggcaccccuuaugaucccgccgaggacaucccuggcccccuggggacaccugauuuuagaggaaaggucuucggcguggccucccaacggaaccccgacucuacgacccgcgcucaugaagccaaaguugauacaaccgcggggagauuuacaccgaagcucggaagccuggagauuuccaccgaaagcggcgacuucgaucagaaucagccuacgcgguuuacacccguggggaucggagucgacagagaggcugauuuccaacaguggucucugcccgacuacuccggccaguuuacccacaacaugaaucucgccccugccguggcuccgaacuuccccggcgaacagcugcuguuuuuccgcagccaacuuccuucuagcgggggacgguccaauggcauucucgauugccuggucccccaggagugggugcagcacuuuuaccaggagucugccccugcucaaacccagguugcccuugugagauaugucaaccccgacacagggcgcgugcuguucgaagcgaagcuccauaaacugggauuuaugaccaucgccaagaacggcgacagcccuaucacaguucccccgaauggguacuuccgguucgaguccugggugaacccuuuuuauacgcuggcucccaugggcaccggaaauggcagacgccggauucaguga

SEQ ID NO: 27256 - RNA, 1608 nt, Artificial Sequence
  derived and/or modified sequence opt5 from VP1__Norovirus__AGT39191
augaagauggccagcaacgacgcugcccccuccaaugauggcgcggcugggcuggugccugaggucaccaacgaaacaauggcccucgagccgguugccagagcuucuaucgccgcuccccugacgggacagaauaacgugauugacccuuggaucacccuuaauuucggccaagcccccacagggcaccugacccucagcccucccuacuccccuggagaagugcugcuuaaccuggagcuccggccggaacugaaucccuaucuggcgaaccucucucgcauguacaauggcuaugccgggggagucgaggugcagguucugcuugcuggcaacgccuuuacagcuggcaaacugguguucgccgcggucccuccccauuuuccucucgagaauauuagccccgggcagaucaccauguucccgcacgugauuaucgauguuagaacacuggaaccugugcuucugccccucccugacguccggaacaacuuuuuccauuacaaucagcaaaaugagccccgcaugagacugguggccaugcuguauacgccccuccgguccaacggaucuggcgaugacguguuuacggucagcugccgcguucugaccagaccuuccccggauuucgacuuuaacuaccuugugcccccuacaguggaaagcaagaccaaacccuucacacugccuauccucaccauuggggagcugaccaauucucgguuucccgucccgaucgaugagcuuuauacauccccuaacgaaagccuggugguucagccccagaauggacgcugugcucucgacggcgagcugcaggggaccacacaacugcucccuaccgccauuugcucuuucagaggacggaucaaccagaagguguccggcgaaaaucacgucuggaacaugcagauuaccaauaucaacggcacacccuuugauccuacggaggacgugcccgcuccgcuggggaccccugauuucagcggaaaacuuuucggcguucugucucagcgcgaccaugacaaugccuguagaucccacgaugccgugauugcuacaaacagcgcgaaguuuacccccaagcucggggccauccaaaucggaacaugggaacaggacgauguccacauuaaucagcccaccaaauucacgccugugggccuguuugaguccgagggguucaaccaauggacacuuccgaauuacucuggagcucugacccucaacaugggccuggcucccccugucgcccccaccuuuccuggcgaacagauccuguucuuucggagccauauuccccucaaagggggaguggccgacccuguuaucgauugccugcuuccccaggaguggauucagcaccuguaccaagaauccgccccgagccagacagacguggcgcucauccgcuucaccaauccugauacaggcagaguccuguuugaggcuaagcugcaucggucuggguauaucacgguggccaacaccggauccagacccauuguugugccugccaacggcuacuuccgcuuugacagcugggucaaucaguucuauucucuugcucccauggggacaggcaacggacggagacgcgugcaguga

SEQ ID NO: 27257 - RNA, 1608 nt, Artificial Sequence
  derived and/or modified sequence opt5 from VP1__Norovirus__AGT39194
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgagaaucacguuuggaacaugcagauuaccaauaucaacgggacaccuuucgaucccaccgaagacgugccugcuccccugggaaccccggauuucagcggcaaacucuuugggguccugucucagcgcgaccaugacaaugccuguagaucccacgaugccgugauugcuacaaacagcgcgaaguucacgccuaaacuuggagccauccaaaucggcaccugggagcaggacgauguccacauuaaucagcccacaaaguuuacccccguggggcuguucgaguccgaaggauuuaaccaauggacacucccuaauuauucuggcgcucugacccuuaacaugggccuggccccgcccguugccccuacguuccccggggagcagauccucuuuuuccggagccauauuccucugaagggaggcguggcugaccccgucaucgauugccugcucccucaggaauggauucagcaccuguaccaagaguccgcccccagccagacagacguggcgcuuauccgcuuuaccaacccggauaccgggagaguucuguucgaagcuaaacuccaucggucuggauacaucacaguggccaauaccggcuccagaccuauugucgugcccgccaacggguauuuucgcuucgacagcugggugaaucaguuuuacucucuggcuccuaugggcacaggaaacggccggagacgcguucaguga

SEQ ID NO: 27258 - RNA, 1608 nt, Artificial Sequence
  derived and/or modified sequence opt5 from VP1__Norovirus__AGT39197
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgagaaucacguuuggaacaugcaagugaccaauauuaacgggacaccuuucgaucccaccgaagacgucccugcuccccugggaaccccggauuucagcggcaaacucuuuggggugcugucucagcgcgaccaugacaaugccuguagaucccacgaugccgucaucgcuacaaacagcgcgaaguucacgccuaaacuuggagccauucagaucggcaccugggaggagaaugacgugcacaucaaccagcccacaaaguuuacccccguugggcuguucgaauccgagggauuuaaucaguggacacucccuaacuauucuggcgcucugacccuuaacaugggccuggccccgcccguggccccuacguuccccggggaacaaauucucuuuuuccggagccauaucccucugaagggaggcgucgcugaucccgugauugacugccugcucccucaggaguggauccagcaccuguaccaggaauccgcccccagccaaacagauguugcgcuuauucgcuuuaccaauccggacaccgggagagugcuguucgaggcuaaacuccaucggucuggauacaucacagucgccaacaccggcuccagaccuaucguggugcccgccaauggguauuuucgcuucgauagcuggguuaaccaguuuuacucucuggcuccuaugggcacaggaaauggccggagacgcguccaguga

SEQ ID NO: 27259 - RNA, 1608 nt, Artificial Sequence
  derived and/or modified sequence opt5 from VP1__Norovirus__AGT39200
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgagaaucacguuuggaacaugcagauuaccaauaucaacgggacaccuuucggacccaccgaagaugugccugcuccccugggcaccccggacuucagcgggaaacucuuuggaguccugucucagcgcgaucaugacaaugccuguagaucccacgacgccgugauugcuacaaacagcgcgaaguucacgccuaaacuuggcgccauccaaaucgggaccugggagcaggaugacguccacauuaaucagcccacaaaguuuacccccgugggacuguucgaguccgaaggcuuuaaccaauggacacucccuaauuauucuggcgcucugacccuuaacauggggcuggccccgcccguugccccuacguuccccggagagcagauccucuuuuaccggagccauauuccucugaagggcgggguggcugaucccgucaucgacugccugcucccucaggaauggauucagcaccuguaccaagaguccgcccccagccagacagauguggcgcuuauccgcuucaccaacccggacaccggaagaguucuguuugaagcuaaacuccaucggucuggcuauaucacaguggccaauaccggguccagaccuauugucgugcccgccaacggcuacuuccgcuuugauagcugggugaaucaguucuauucucuggcuccuaugggaacaggcaacgggcggagacgcguucaguga

SEQ ID NO: 27260 - RNA, 1608 nt, Artificial Sequence; identical to SEQ ID NO: 26688
  derived and/or modified sequence opt5 from VP1__Norovirus__AGT39203

SEQ ID NO: 27261 - RNA, 1629 nt, Artificial Sequence
  derived and/or modified sequence opt5 from VP1__Norovirus__AGT39206
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccuagaaacucccccggagaggugcuucugaaucucgaacugggcccugagcuuaacccguaccuggcucaccucgcccgcauguauaauggguacgcuggaggcauggagguucaggugaugcuggccggcaacgcguucacagccgggaaacuggucuuugcugccgugcccccucauuuccccguugaaaaucucucuccucagcagauuaccauguuuccccacgugaucauugaugucagaacacuggagccggugcuucugccucuccccgacgugcggaacaauuucuuucauuauaaccaaaaggaugacccuaaaaugcgcaucgucgcuaugcuguacacaccccuuagaagcaauggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaacucuagauucccuguuuccauugaucagauguacaccagccccaacgaggugaucucuguccagugucagaauggacggugcacgcuugacggcgaacugcaagggacaacccagcuccagguguccggaauuugugccuuuaagggcgagguuacagcccaucugcacgauaacgaccaccuuuauaaugugaccaucaccaaccugaauggcagcccguucgacccuucugaagauauucccgcuccucucgggguccccgacuuccagggacgcguguuuggcgucaucucccaaagagauaagcacaacacaccugggcauaaugagcccgcgaaccgggcccacgacgcugugguuccgacguacaccgcccaguacacaccuaaacugggacagauucaaaucggcaccuggcagacagaugaccugaccgugaaucagcccgucaaguucacgcccguggggcucaacgauacagaccauuuuaaucaguggguugugccucgcuaugccggagcucugaaccuuaauaccaaccuggccccgagcgucgcgcccguguucccuggcgaaagacuccuguuuuuccgguccuacaucccccuuaaaggcggguauggaaccccugcuauugauugccugcucccccaagagugggugcagcacuuuuaccaggaggccgccccuucuaugagcgaaguugcucugguccgcuauaucaaucccgacacaggcagagcccuguucgaggcuaagcuccaccgggccggguuuaugaccguguccagcaacacaucugcgccgguggucgugccugccaacggauacuucagauuugauuccuggguuaaucaguucuauagccuggcucccaugggcacggggaacggccgccggcggauucaauga

SEQ ID NO: 27262 - RNA, 1623 nt, Artificial Sequence
  derived and/or modified sequence opt5 from VP1__Norovirus__AHF45991
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccuccacccaggaguacaccaugaaccucgcuagccagaauuggaacaauuaugaucccacagaagagauuccugcgccccugggaacgccggacuucgugggcaaaauccagggcguccuuacccaaacaaccagacgggacggguccacacgcggacacaaggccaccgugucuacgggcagcguucauuuuacaccuaagcuggggcggauucaguucuccaccgauaccagcaacgacuuugaaacaggacagaauaccagauucacacccgugggcgucgugcaagaugggucuacgacccaccagaacgagccccagcaguggguucucccuaauuacuccggacgcgacagccacaacgugcaucuggcuccggccgucgcccccucuuuuccuggcgaacaacuucuguucuuuagaagcacaaugcccggcuguuccggguacccuaauaugaaccucgauugccugcugccccaggagugggugcagcacuucuaucaggaggcugccccugcgcaaucugacguggcucuccugcgguuuguuaaucccgauaccggaagaguccuuuucgaauguaaacugcauaagagcggcuacgugacaguggcccacaccgggcagcacgaccucgucaucccgccuaacggauauuuucgcuucgauuccugggugaaccaguucuacacgcuggcccccaugggcaaugggaccggccggagacgcgcucuuuga

SEQ ID NO: 27263 - RNA, 1623 nt, Artificial Sequence; identical to SEQ ID NO: 26482
  derived and/or modified sequence opt5 from VP1__Norovirus__AHF45993

SEQ ID NO: 27264 - RNA, 1623 nt, Artificial Sequence; identical to SEQ ID NO: 27139
  derived and/or modified sequence opt5 from VP1__Norovirus__AHF45997

SEQ ID NO: 27265 - RNA, 1623 nt, Artificial Sequence; identical to SEQ ID NO: 27139
  derived and/or modified sequence opt5 from VP1__Norovirus__AHF45999

SEQ ID NO: 27266 - RNA, 1623 nt, Artificial Sequence; identical to SEQ ID NO: 27139
  derived and/or modified sequence opt5 from VP1__Norovirus__AHF46001

SEQ ID NO: 27267 - RNA, 1617 nt, Artificial Sequence
  derived and/or modified sequence opt5 from VP1__Norovirus__AHH44876
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccgugcugaccgucgaggaaaugacaaacuccagauuuccuaucccccuugagaagcuguucaccgggccgagcucugccuucgugguucagccucagaauggacgguguacaaccgauggcgugcuccuggggacgacacaacuguccgcugucaacauuugcaccuuucgcggagacgugacacaugucagcgauaaaaccuucgcgaugaaucucgccucucccaacuggaauaacuacgacccuaccgaggacauccccgcuccucugggcacacccgauuuugugggcagaauccacgggaugcuuacgcagaccacacggcgcgacggagccaccagaggccauaaggccacaguuuccaccgggggagcugauuucacgccgaagcugggcagcgugcgguauauuacagacaccaccgaugaccucgaaguccgcgagaauacaaaauuuaccccuaucggggugcugcacuccucuggagaacacagagccgagcccgaucaguggcggcuucccgaauacagcggcagaaacguucauaaugugcaccuggcgccugcugucgccccgacauuccccggcgagcagcuccuguuuuuccgcuccgcccugccuggguguggaggcuaccccaacacggaccucgauugccugcuuccucaagagugggugcagcauuuuuaucaggaagcugcccccgcucaaagcgacguggcccugcuccgguucguuaauccugauaccgggagaguccuguuugaguguaaacuucacaagucuggauacgugacaguggcgcacaccggcccccaugaccuggucauuccgccuaacggguauuuccgcuuugacuccugggugaaucaguucuacacacucgcccccaugggcaacggaaccggccggagacgcgcucuguga

SEQ ID NO: 27268 - RNA, 1617 nt, Artificial Sequence
  derived and/or modified sequence opt5 from VP1__Norovirus__AHH44877
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacaccccuucgcgcuaacaacgccggcgaugacguuuucaccguguccugcagagugcugacccggcccagcccugauuuugacuucauuuuucucgucccgcccacaguggaaucucgcaccaagccuuucuccguucccgugcugacggucgaggaaaugaccaauagcagauuuccuaucccccuugagaaacuguucacagggccgucuuccgccuucgugguucagccucagaacggacgguguaccacagauggcgugcuccuggggaccacgcaacugagcgcugucaauauuugcacauuucgcggagacgugacccaugucgcgggcgauacauucgccaugaaccucgcuucucugaauuggaacaauuacgaccccaccgaggaaaccccugcuccccuuggcacaccugacuuuguggggagaauccacggaaugcugacgcagaccacacgguccgauggcgccacccgcgcccauaaggccacaguuagcaccgggggagcggacuucacgcccaagcucggcuccgugagauauucuacagauaccagcggggaccuggagguccgggaaaacaccaaauuuacaccgaucggagugcuucacuccagcggcgagcgcagagcugaaccugagcaguggcggcugcccgaguacucuggcagaaauguucacaacgugcaucucgcccccgccgucgcuccuaccuucccgggggaacagcugcuguuuuuccgcuccacaaugcccggauguggcggguacccuaauauggaucucgacugccugcuuccccaagagugggugcagcacuuuuaucaggaagccgcuccugcccaaagcgauguggcgcugcuccgguucguuaaccccgacacgggaagaguccuguuugaguguaaacuucauaagucuggcuacgugaccguggcccacacagggccucacgaucuggucauucccccgaauggcuauuuccgcuuugacagcugggugaaccaguucuacacccucgcuccuaugggaaauggcacagggcggagacgcgcccuguga

SEQ ID NO: 27269 - RNA, 1617 nt, Artificial Sequence
  derived and/or modified sequence opt5 from VP1__Norovirus__AHH44878
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccauuuccccucggaaugcgcccggagagauccuguggucugccccucuuggcccggaucugaaccccuaccucagccaccuggcucgcauguauaauggguacgccggaggcuucgaagugcaggucgugcuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaggacuccacaauuaaacucaucgccaugcuguauacaccccuucgcgcuaauaacgccggcgaugacguuuucaccgugagcugcagagugcugacccggcccucuccugauuuugacuucauuuuucucgucccgcccacaguggaaucccgcaccaagccuuucagcguucccgugcugacggucgaggaaaugaccaacucuagauuuccuaucccccuugagaaacuguucacagggccguccagcgccuucgugguucagccucagaauggacgguguaccacagauggcgugcuccuggggaccacgcaacugucugcugucaacauuugcacauuucgcggagacgugacccaugucgcgggcgauacauucgccaugaaucucgcuucccugaacuggaauaacuacgaccccaccgaggaaaccccugcuccccuuggcacaccugacuuuguggggagaauccacggaaugcugacgcagaccacacggagcgauggcgccacccgcgcccauaaggccacaguuuccaccgggggagcggacuucacgcccaagcucggcucugugagauauagcacagauaccuccagcgaccuggagguccgggaaaauaccaaauuuacaccgaucggggugcuucacucuuccggaggccaccgcgcugagccugaucaguggagacugcccgaauacagcggccggaacguucauaaugugcaccucgcccccgccgucgcuccuaccuucccgggggagcagcugcuguuuuucagaucuacaaugcccggauguggcggguacccuaacauggaccucgauugccugcuuccccaagagugggugcagcauuuuuaucaggaagccgcuccugcccaaagcgacguggcgcugcuccgcuucguuaaucccgauacgggacggguccuguuugaguguaaacuucacaaguccggcuacgugaccguggcccacacagggccucaugaccuggucauucccccgaacggcuauuucagauuugauucuugggugaaucaguucuacacccucgcuccuaugggaaacggcacagggcgccggagagcccuguga

SEQ ID NO: 27270 - RNA, 1617 nt, Artificial Sequence
  derived and/or modified sequence opt5 from VP1__Norovirus__AHH44879
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacaccccuucgcgcuaacaacgccggcgaugacguuuucaccguguccugcagagugcugacccggcccagcccugauuuugacuucauuuuucucgucccgcccacaguggaaucucgcaccaagccuuucuccguucccgugcugacggucgaggaaaugaccaauagcagauuuccuaucccccuugagaaacuguucacagggccgucuuccgccuucgugguucagccucagaacggacgguguaccacagauggcgugcuccuggggaccacgcaacugagcgcugucaauauuugcacauuucgcggagacgugacccaugucgcgggcgauacauucgccaugaaccucgcuucucugaauuggaacaauuacgaccccaccgaggaaaccccugcuccccuuggcacaccugacuuuguggggagaauccacggaaugcugacgcagaccacacgguccgauggcgccacccgcgcccauaaggccacaguuagcaccgggggagcggacuucacgcccaagcucggcuccgugagauauucuacagauaccagcuccgaccuggagguccgggaaaacaccaaauuuacaccgaucggggugcuucacagcucuggaggccaccgcgcugagccugaucaguggagacugcccgaauacuccggccggaauguucauaacgugcaccucgcccccgccgucgcuccuaccuucccgggggagcagcugcuguuuuucagaagcacaaugcccggauguggcggguacccuaauauggaccucgauugccugcuuccccaagagugggugcagcauuuuuaucaggaagccgcuccugcccaaucugacguggcgcugcuccgcuucguuaaccccgauacgggacggguccuguuugaguguaaacuucacaagagcggcuacgugaccguggcccacacagggccucaugaccuggucauucccccgaauggcuauuucagauuugauuccugggugaaccaguucuacacccucgcuccuaugggaaauggcacagggcgccggagagcccuguga

SEQ ID NO: 27271 - RNA, 1617 nt, Artificial Sequence
  derived and/or modified sequence opt5 from VP1__Norovirus__AHH44880
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaaggacagcacaauuaaacucaucgccaugcuguauacaccccuucgcgcuaacaacgccggcgaugacguuuucaccguguccugcagagugcugacccggcccagcccugauuuugacuucauuuuucucgucccgcccacaguggaaucucgcaccaagccuuucuccguucccgugcugacggucgaggaaaugaccaauagcagauuuccuaucccccuugagaaacuguucacagggccgucuuccgccuucgugguucagccucagaacggacgguguaccacagauggcgugcuccuggggaccacgcaacugagcgcugucaauauuugcacauuucgcggagacgugacccaugucgcgggcgauacauucgccaugaaccucgcuucucugaauuggaacaauuacgaccccaccgaggaaaccccugcuccccuuggcacaccugacuuuguggggagaauccacggaaugcugacgcagaccacacgguccgauggcgccacccgcgcccauaaggccacaguuagcaccgggggagcggacuucacgcccaagcucggcuccgugagauauucuacagauaccagcuccgaccuggagguccgggaaaacaccaaauuuacaccgaucggggugcuucacagcucuggaggccaccgcgcugagccugaucaguggagacugcccgaauacuccggccggaauguucauaacgugcaccucgcccccgccgucgcuccuaccuucccgggggagcagcugcuguuuuucagaagcacaaugcccggauguggcggguacccuaauauggaccucgauugccugcuuccccaagagugggugcagcauuuuuaucaggaaacggccccugcucaaucugacguggcccugcuccgcuucguuaaccccgauaccggacggguccuguuugaguguaaacuucacaagagcggcuacgugacaguggcgcacaccgggccucaugaccuggucauucccccgaauggcuauuucagauuugauuccugggugaaccaguucuacacacucgccccuaugggaaauggcaccgggcgccggagagcucuguga

SEQ ID NO: 27272 - RNA, 1617 nt, Artificial Sequence
  derived and/or modified sequence opt5 from VP1__Norovirus__AHH44881
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaguuauuuucgccgcugugccucccaacuuuccuacggagggacugagccccucccaggucaccauguucccgcauaucaucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaugacguguucaccguguccugcagaguccugacccggcccagcccugauuuugacuucaucuuucucgugccgcccacaguugaaucucgcaccaaaccuuucuccgugcccguccugacgguggaggaaaugaccaacagcagauuuccuauuccccuugagaagcuguucacagggccgucuuccgccuucguugugcagccucagaauggacgguguaccacagauggcguccuccuggggaccacgcaacugagcgcugugaacaucugcacauuucgcggagacgucacccauguggcgggcgauacauucgccaugaaucucgcuucucugaacuggaauaacuacgaccccaccgaggaaaccccugcuccccuuggcacaccugacuuuguugggagaauccacggaaugcugacgcagaccacacgguccgauggcgccacccgcgcccauaaagccacagugagcaccgggggagcggacuucacgcccaagcucggcuccgucagauauucuacagauaccagcuccgaccuggaggugcgggaaaauaccaaguuuacaccgaucgggguucuucacagcucuggaggccaccgcgcugagccugaucaguggagacugcccgaauacuccggccggaacgugcauaauguccaccucgcccccgccguggcuccuaccuucccgggggagcagcugcuguuuuucagaagcacaaugcccggauguggcggguacccuaacauggaccucgauugccugcuuccccaagagugggugcagcauuuuuaucaggaagccgcuccugcccaaucugacguugcgcugcuccgcuucgucaaucccgauacgggacgggugcuguuugaguguaaacuucacaagagcggcuacgugaccgucgcccacacagggccucaugaccuggugauucccccgaacggcuauuucagauuugauuccuggguuaaucaguucuacacccucgcuccuaugggaaacggcacagggcgccggagagcccuguga

SEQ ID NO: 27273 - RNA, 1617 nt, Artificial Sequence
  derived and/or modified sequence opt5 from VP1__Norovirus__AHH44884
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccauuagcccucggaacgcgcccggagagauccugugguccgccccucuuggcccggaucugaaucccuaccucucucaccuggcucgcauguauaacggguacgccggaggcuucgaagugcaggucgugcuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcauuaucaagcucauugccaugcuguauacaccccuucgcgcuaacaaugccggcgaugacguuuucaccguguccugcagagugcugacacggcccagcccugauuuugacuucaucuuucucgucccgcccaccguggaaucucgcacaaaaccuuucaccguucccgugcugacggucgaugagaugaccaacuccagauuuccuauuccccuugaaaagcuguucacagggccgagcucugccuucgugguucagccucagaauggacgguguaccacagacggcgugcuccuggggaccacgcaacuguccgcugucaacaucugcacauuucgcggagaugugacccaugucagcgacaaaacauucgcgaugaaucucgccucucccaacuggaauaacuacgacccuaccgaggagauccccgcuccucugggcacccccgauuuugugggccggauucacgggaugcuuacacagacgaccagacgcgacggagccacaagaggccauaaggccaccguuuccacagggggagcugauuucaccccgaagcugggcagcgugcgguauaucacggacacaaccgaugaccucgaaguccgcgagaauaccaaauuuacaccuauuggggugcugcacuccucuggagaacacagagccgagcccgaucaguggcggcuucccgaauacagcggcagaaacguucauaaugugcaccuggcgccugcugucgccccgaccuuccccggcgagcagcuccuguuuuuccgcuccgcccugccuggguguggaggcuaccccaacacagaccucgauugccugcuuccucaagagugggugcagcauuuuuaucaggaagcugcccccgcucaaagcgacguggcccugcuccgguucguuaauccugauacggggagaguccuguuugaguguaaacuucacaagucuggauacgugaccguggcgcacacaggcccccaugaccuggucaucccgccuaacggguauuuccgcuuugacuccugggugaaucaguucuacacccucgcccccaugggcaacggaacaggccggagacgcgcucuguga

SEQ ID NO: 27274 - RNA, 1620 nt, Artificial Sequence
  derived and/or modified sequence opt5 from VP1__Norovirus__AHH44886
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucacaggcaccagcgaauacgcuaugaaucuggcgucucagaacuggaauaacuaugaccccaccgaggaaaucccugcuccccuuggggccccggauuuugugggaaagaucagaggcaugcugacacagacgacccggcgcgacggguccacaagaggacaccgggccacccucagcacaggcuccgcccauuucaccccuaagcuggggucuauucgcuuuagcacggacacaaauaacgauuucgaggcuggacagaauaccaaauuuacccccgucggcguguuccaagaaggcgacaaccaccagaaugagccccagcaauggguucuuccuaacuacuccggggccacagcgcacaaugugcaucuggcuccggccgucgcccccgcuuuuccuggagagcagcuccuguucuuuagaagcaccaugcccggcugugggggauacccuaacaugaaucuggauugccuccugccccaggaaugggugcagcacuucuaucaagaggccgcuccugcccagucugacguugcgcuucugcgguuugugaaccccgauacauccagaguccucuucgaauguaagcugcauaaaagcggcuacgugacgguggcccacaccgggcagcacgaccuuguuaucccgccuaacggcuauuuccgcuuugauucuugggucaaucaguucuacacacuggcucccaugggaaacggcaccgggcggagacgcgcccucuga

SEQ ID NO: 27275 - RNA, 1620 nt, Artificial Sequence
  derived and/or modified sequence opt5 from VP1__Norovirus__AHH44888
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucacaggcaccagcgaauacgcuaugaaucuggcgucucagaacuggaauaacuaugaccccaccgaggaaaucccugcuccccuuggggccccggauuuugugggaaagaucagaggcaugcugacacagacgacccggcgcgacggguccacaagaggacaccgggccacccucagcacaggcuccgcccauuucaccccuaagcuggggaauauucgcuuuucuacggacacaaacaaugauuucgaggcuggacagaacaccaaauuuacccccgucggcguguuccaagaaggcgacaaucaccagaacgagccccagcaauggguucuuccuaauuacagcggggccacagcgcacaacgugcaucuggcuccggccgucgcccccgcuuuuccuggagagcagcuccuguucuuuagauccaccaugcccggcugugggggauacccuaauaugaaccuggauugccuccugccccaggaaugggugcagcacuucuaucaagaggccgcuccugcccagagcgacguugcgcuucugcgguuugugaaccccgauacaucuagaguccucuucgaauguaagcugcauaaauccggcuacgugacgguggcccacaccgggcagcacgaccuuguuaucccgccuaauggcuauuuccgcuuugauagcugggucaaccaguucuacacacuggcucccaugggaaauggcaccgggcggagacgcgcccucuga

SEQ ID NO: 27276 - RNA, 1620 nt, Artificial Sequence
  derived and/or modified sequence opt5 from VP1__Norovirus__AHH44889
augaagauggccagcaacgacgcuucccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucgucguggacgugagacaacucgagccuguccugauuccccugccugauguucggaauaacuuuuaucacuacaaucaguccaaggaccccacaaucaaacucauugccaugcuguauacaccccuucgcgcuaacaaugccggcgaagauguguucaccgugagcugcagaguccugacccggccuucuccggacuuugauuucaucuuucucgugcccccuacaguugagucccgcagcaagcccuucaccgugccuauucugacggucgaagagaugaccaacucuagauuucccaucccgcuugagaaacuguucacagggccuuccggagccuucgugguucagccccagaacggccgguguaccacagacggggugcuccugggaaccacgcaacugagcccugucaauauuugcacauuucgcggcgaucucacccauuucacaggcaccucugaauacgcuaugaaccuggcgucccagaauuggaacaauuaugaccccaccgaggaaaucccugcuccccuuggggccccggauuuugugggaaagaucagaggcaugcugacacagacgacccggcgcgacgggagcacaagaggacaccgggccacccucuccacaggcucugcccauuucaccccuaagcuggggagcauucgcuuuuccacggacacaaacaaugauuucgaggcuggacagaacaccaaauuuacccccgucggcaucuuccaagaaggcgacaaucaccagaacgagccccagcaaugggugcuuccuaauuacagcggggccacagcgcacaacguucaucuggcuccggccguggcccccgcuuuuccuggagagcagcuccuguucuuuagaucuaccaugcccggcugugggggauacccuaauaugaaccuggauugccuccugccccaggaauggguccagcacuucuaucaagaggccgcuccugcccaguccgacguggcgcuucugcgguuuguuaaucccgauacaagcagaguccucuucgaauguaagcugcauaaaucuggcuacgugacgguggcccacaccgggcagcacgaccuugugauuccgccuaacggcuauuuccgcuuugauagcuggguuaaccaguucuacacacuggcucccaugggaaauggcaccgggcggagacgcgcccucuga

SEQ ID NO: 27277 - RNA, 1620 nt, Artificial Sequence; identical to SEQ ID NO: 27275
  derived and/or modified sequence opt5 from VP1__Norovirus__AHH44890

SEQ ID NO: 27278 - RNA, 1620 nt, Artificial Sequence; identical to SEQ ID NO: 27275
  derived and/or modified sequence opt5 from VP1__Norovirus__AHH44891

SEQ ID NO: 27279 - RNA, 1620 nt, Artificial Sequence; identical to SEQ ID NO: 27275
  derived and/or modified sequence opt5 from VP1__Norovirus__AHH44893

SEQ ID NO: 27280 - RNA, 1620 nt, Artificial Sequence
  derived and/or modified sequence opt5 from VP1__Norovirus__AHH44894
augaagauggccagcaacgacgcuucccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucgucguggacgugagacaacucgagccuguccugauuccccugccugauguucggaauaacuuuuaucacuacaaucaguccaaggaccccacaaucaaacucauugccaugcuguauacaccccuucgcgcuaacaaugccggcgaagauguguucaccgugagcugcagaguccugacccggccuucuccggacuuugauuucaucuuucucgugcccccuacaguugagucccgcagcaagcccuucaccgugccuauucugacggucgaagagaugaccaacucuagauuucccaucccgcuugagaaacuguucacagggccuuccggagccuucgugguucagccccagaacggccgguguaccacagacggggugcuccugggaaccacgcaacugagcccugucaauauuugcacauuucgcggcgaucucacccauuucacaggcaccucugaauacgcuaugaaccuggcgucccagaauuggaacaauuaugaccccaccgaggaaaucccugcuccccuuggggccccggauuuugugggaaagaucagaggcaugcugacacagacgacccggcgcgacgggagcacaagaggacaccgggccacccucuccacaggcucugcccauuucaccccuaagcuggggagcauucgcuuuuccacggacacaaacaaugauuucgaggcuagccagaacaccaaauuuacccccgucggaguguuccaagaaggcgacaaucaccagaacgagccccagcaauggguucuuccuaauuacucuggcgccacagcgcacaacgugcaucuggcuccggccgucgcccccgcuuuuccuggggagcagcuccuguucuuuagauccaccaugcccggauguggcggguacccuaauaugaaccuggauugccuccugccccaggaaugggugcagcacuucuaucaagaggccgcuccugcccagagcgacguugcgcuucugcgguuugugaaucccgauacaucuagaguccucuucgaauguaagcugcauaaaagcggauacgugacgguggcccacaccggccagcacgaccuuguuaucccgccuaacggguauuuccgcuuugauuccugggucaaccaguucuacacacuggcucccaugggcaauggaaccggccggagacgcgcccucuga

SEQ ID NO: 27281 - RNA, 1620 nt, Artificial Sequence
  derived and/or modified sequence opt5 from VP1__Norovirus__AHH44895
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucacaggcaccagcgaauacgcuaugaaucuggcgucucagaacugggacaauuaugaucccaccgaggaaaucccugcuccccuuggggccccggacuuugugggaaagaucagaggcaugcugacacagacgacccggcgcgacggguccacaagaggacaccgggccacccucagcacaggcuccgcccauuucaccccuaagcuggggaacauucgcuuuucuacggauacaaauaacgacuucgaggcuggacagaauaccaaauuuacccccgucggcguguuccaagaaggcgauaaccaccagaaugagccccagcaauggguucuuccuaacuacagcggggccacagcgcacaaugugcaucuggcuccggccgucgcccccgcuuuuccuggagagcagcuccuguucuuuagauccaccaugcccggcugugggggauacccuaacaugaaucuggacugccuccugccccaggaaugggugcagcacuucuaucaagaggccgcuccugcccagagcgauguugcgcuucugcgguuugugaaccccgacacaucuagaguccucuucgaauguaagcugcauaaauccggcuacgugacgguggcccacaccgggcagcacgaucuuguuaucccgccuaacggcuauuuccgcuuugacagcugggucaaucaguucuacacacuggcucccaugggaaacggcaccgggcggagacgcgcccucuga

SEQ ID NO: 27282 - RNA, 1620 nt, Artificial Sequence; identical to SEQ ID NO: 27275
  derived and/or modified sequence opt5 from VP1__Norovirus__AHH44896

SEQ ID NO: 27283 - RNA, 1620 nt, Artificial Sequence; identical to SEQ ID NO: 27275
  derived and/or modified sequence opt5 from VP1__Norovirus__AHH44897

SEQ ID NO: 27284 - RNA, 1620 nt, Artificial Sequence; identical to SEQ ID NO: 27275
  derived and/or modified sequence opt5 from VP1__Norovirus__AHH44899

SEQ ID NO: 27285 - RNA, 1620 nt, Artificial Sequence
  derived and/or modified sequence opt5 from VP1__Norovirus__AHH44900
augaagauggccagcaacgacgcuucccccucugauggcagcgccgcgaaucuggugccugaggucaacaaugaaguuauggcucucgagccgguggugggggccaccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucgucguggacgugagacaacucgagccuguccugauuccccugccugauguucggaacaauuuuuaucacuacaaccagagcaaggaccccaccaucaaacucauugcuaugcuguauacaccccuucgcgccaauaacgcuggcgaagauguguucaccguguccugcagaguccugacacggccuagcccggacuuugauuucaucuuucucgugucucccaccguugagucccgcagcaagccuuucacggugcccauucugaccgucgaagagaugacaaacucuagauuuccuaucccccuugagaaacuguucaccgggccguccggagccuucgugguucagccucagaauggccgguguacaaccgacggggugcuccugggaacgacacaacugagccccgucaacauuugcaccuuucgcggcgaucucacacauuucaccggcaccucugaauacgccaugaaucuggcuucccagaacuggaauaacuaugacccuacagaggaaauccccgcgccucuuggggcccccgauuuugugggaaagaucagaggcaugcugacgcagaccacacggcgcgacgggagcaccagaggacaccgggcuacacucuccaccggcucugcccauuucacgccgaagcuggggaauauucgcuuuagcacagacaccaacaaugauuucgaggccggacagaacaccaaauuuacaccugucggcguguuccaagaaggcgacaaucaccagaacgagccccagcaauggguucuucccaauuacuccggggcuaccgcccacaacgugcaucuggcgccugcugucgccccggccuuucccggagagcagcuccuguucuuuagaagcacaaugccuggcugugggggauaccccaauaugaaccuggauugccuccugccucaggaaugggugcagcacuucuaucaagaggcugcccccgcucagucugacguugcccuucugcgguuugugaacccugauacguccagaguccucuucgaauguaagcugcauaaaagcggcuacgugaccguggcgcacacagggcagcacgaccuuguuauucccccgaauggcuauuuccgcuuugauucuugggucaaccaguucuacacccuggccccuaugggaaauggcacagggcggagacgcgcucucuga

SEQ ID NO: 27286 - RNA, 1620 nt, Artificial Sequence; identical to SEQ ID NO: 27275
  derived and/or modified sequence opt5 from VP1__Norovirus__AHH44902

SEQ ID NO: 27287 - RNA, 1620 nt, Artificial Sequence
  derived and/or modified sequence opt5 from VP1__Norovirus__AHH44904
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugucucccacaguugagucccgcagcaagccuuucaccgugcccauucugacggucgaagagaugaccaacucuagauuuccuaucccccuugagaaacuguucacagggccguccggagccuucgugguucagccucagaauggccgguguaccacagacggggugcuccugggaaccacgcaacugagccccgucaacauuugcacauuucgcggcgaucucacccauuucacaggcaccucugaauacgcuaugaaucuggcgucccagaacuggaauaacuaugacccuaccgaggaaauccccgccccucuuggggcucccgauuuugugggaaagaucagaggcaugcugacacagacgacccggcgcgacgggagcacaagaggacaccgggccacccucuccacaggcucugcccauuucaccccgaagcuggggaauauucgcuuuagcacggacacaaacaaugauuucgaggcuggacagaacaccaaauuuaccccugucggcguguuccaagaaggcgacaaucaccagaacgagccccagcaauggguucuucccaauuacuccggggccacagcgcacaacgugcaucuggcuccugccgucgccccggcuuuucccggagagcagcuccuguucuuuagaagcaccaugccuggcugugggggauaccccaauaugaaccuggauugccuccugccucaggaaugggugcagcacuucuaucaagaggccgcucccgcccagucugacguugcgcuucugcgguuugugaacccugauacauccagaguccucuucgaauguaagcugcauaaaagcggcuacgugacgguggcccacaccgggcagcacgaccuuguuauucccccgaauggcuauuuccgcuuugauucuugggucaaccaguucuacacacuggcuccuaugggaaauggcaccgggcggagacgcgcccucuga

SEQ ID NO: 27288 - RNA, 1620 nt, Artificial Sequence; identical to SEQ ID NO: 27275
  derived and/or modified sequence opt5 from VP1__Norovirus__AHH44905

SEQ ID NO: 27289 - RNA, 1620 nt, Artificial Sequence
  derived and/or modified sequence opt5 from VP1__Norovirus__AHH44906
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccuacagcagauuucccaucccgcuugagaaacuguucacagggccuucuuccgccuucgugguucagccccagaacggacgguguaccacagacggcgugcuccuggggaccacgcaacugagcccugucaauauuugcacauuucgcggagaucucacccauuucgcuggcacaucugaauaugcgaugaaccuggccucccagaauuggaccaacuacgaccccaccgaggaaaucccugcuccccuuggcgccccggauuuuguggggaagaucagaggaguccugacacagacgacccggggcgacgggagcacacgcggacacagagccacccucuccacaggcucugcucauuucaccccuaagcuggggagcgugcgguuuuccacggacacaaauaacgauuucgaggccggacagaauaccaaauuuacccccguuggcguguuccaagacggcgauaaccaccagaaugaaccccagcaauggguccuuccuaacuacagcggggcgacagcucacaaugugcaucuggccccggccguugcucccgccuuuccuggagagcagcuccuguucuuucgcucuaccaugcccggcuguuccggguauccuaacaugaaucuggacugccuccugccccaggagugggugcagcacuucuaccaagaagcugccccugcgcagagcgaugucgcccuucugagauuugugaaccccgacacaucucggguucucuucgaguguaagcugcauaaaagcggauaugugacggucgcucacaccggccagcacgaucuugugauuccgccuaauggguacuucagauuugacuccugggugaaccaguucuauacacuggcccccaugggcaacggaaccggccgccggagagcucucuga

SEQ ID NO: 27290 - RNA, 1620 nt, Artificial Sequence
  derived and/or modified sequence opt5 from VP1__Norovirus__AHH44907
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaaauucguucaggcccccggcggggaauuuaccguguccccucggaacgcgcccggagagauucuguggucugccccucuuggcccggaucugaaucccuaccucagccaccuggcucgcauguauaacggguacgccggaggcuucgaaguccaggugauccuugcuggcaaugccuuuacagcggggaagauuaucuucgccgcuguuccucccaacuuuccuacggagggacugucccccucucaggugaccauguucccgcauaucgucguggacgugagacaacucgagccuguccugauuccccugccugauguucggaauaacuuuuaucacuacaaucagagcaaagaccccacaaucaagcucauugccaugcuguauacaccccuucgcgcuaacaaugccggcgaagauguguucaccguguccugcagaguccugacccggccuagcccggacuuugauuucaucuuucucgugcccccuacaguugagucucgcuccaaacccuucaccgugccuauucugacggucgaagagaugaccaacagcagauuucccaucccgcuugagaagcuguucacagggccuucuggagccuucgugguucagccccagaacggccgguguaccacagacggggugcuccugggaaccacgcaacuguccccugucaauauuugcacauuucgcggcgaucucacccauuucgcuggcacacacgaauacgcgaugaaccuggccagccagaauuggaacaauuaugaccccaccgaggaaaucccugcuccccuuggggccccggauuuugugggaaagaucagaggcguccugacccagacaacgcggcgcgacgggucuaccagaggacaucgggccacacucuccaccggcagcgcucacuucacaccuaaacugggguccauucgcuuuucuaccgacacgaacaaugauuucgaggccggacagaacacaaaguuuacccccgugggcguuuuccaagacggcgauaaucaccagaacgaaccccagcaaugggugcuuccuaauuacagcggggcgaccgcucauaacguccaccuggccccggccguggcucccgccuuuccuggagagcagcuccuguucuuuagauccacaaugcccggcuguagcggguacccuaauaugaaccuggacugccuccugccccaggaguggguucagcauuucuaucaagaagcugccccugcgcagucugauguggcccuucugcgguuugucaaucccgacaccuccagaguucucuucgaguguaaacugcacaagagcggauacgugacaguggcucacacgggccagcaugaucuugucaucccgccuaacggguauuuccgcuuugacucuugggugaaccaguucuacacccuggcccccaugggcaauggaacaggccggagaugcgcucucuga

SEQ ID NO: 27291 - RNA, 1620 nt, Artificial Sequence
  derived and/or modified sequence opt5 from VP1__Norovirus__AHH44908
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacaucugaauacgcgaugaaucuggccucccagaacuggaccaauuaugaccccaccgaggaaaucccugcuccccuuggcgccccggauuuuguggggaagaucagaggaguccugacacagacgacccggggcgacgggagcacacgcggacacagagccacccucuccacaggcucugcucauuucaccccuaagcuggggagcgugcgguuuuccacggacacaaacaaugauuucgaggccggacagaacaccaaauuuacccccguuggcguguuccaagacggcgauaaucaccagaacgaaccccagcaauggguccuuccuaauuacagcggggcgacagcucacaacgugcaucuggccccggccguugcucccgccuuuccuggagagcagcuccuguucuuucgcucuaccaugcccggcuguuccggguacccuaauaugaaccuggacugccuccugccccaggagugggugcagcacuucuaucaagaagcugccccugcgcagagcgaugucgcccuucugagauuugugaaucccgacacaucucggguucucuucgaguguaagcugcauaaaagcggauacgugacggucgcucacaccggccagcacgaucuugugauuccgccuaacggguauuucagauuugacuccugggugaaccaguucuacacacuggcccccaugggcaauggaaccggccgccggagagcucucuga

SEQ ID NO: 27292 - RNA, 1620 nt, Artificial Sequence
  derived and/or modified sequence opt5 from VP1__Norovirus__AHH44909
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccugggaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacaggcccuucuggggccuucgugguucagccccagaauggacgguguaccacagacggcgugcuccuggggaccacgcaacuguccccugucaacauuugcacauuucgcggagaucucacccauuucgcuggcacacacgaauacgcgaugaaucuggccagccagaacuggaauaacuaugaccccaccgaggaaaucccugcuccccuuggcgccccggauuuuguggggaagaucagaggaguccugacccagacaacgcggcgcgacggcucuaccagagggcaucgggccacacucuccaccggaagcgcucacuucacaccuaagcugggcuccauucgcuuuucuaccgacacgaauaacgauuucgaggccgggcagaauacaaaauuuacccccgugggaguuuuccaagacggcgauaaccaccagaaugaaccccagcaaugggugcuuccuaacuacagcggcgcgaccgcucauaauguccaccuggccccggccguggcucccgccuuuccuggggagcagcuccuguucuuuagauccacaaugcccggauguagcggcuacccuaacaugaaucuggacugccuccugccccaggaguggguucagcauuucuaucaagaagcugccccugcgcagucugauguggcccuucugcgguuugucaaccccgacaccuccagaguucucuucgaguguaagcugcacaaaagcggguacgugacaguggcucacacgggacagcaugaucuugucaucccgccuaacggcuauuuccgcuuugacucuugggugaaucaguucuacacccuggcccccauggggaacggcacaggacggagacgcgcucucuga

SEQ ID NO: 27293 - RNA, 1620 nt, Artificial Sequence
  derived and/or modified sequence opt5 from VP1__Norovirus__AHH44911
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucgcuggcacacacgaauacgcgaugaaucuggccagccagaacuggaauaacuaugaccccaccgaggaaaucccugcuccccuuggggccccggauuuugugggaaagaucagaggcguccugacccagacaacgcggcgcgacgggucuaccagaggacaucgggccacacucuccaccggcagcgcucacuucacaccuaagcugggguccauucgcuuuucuaccgacacgaauaacgauuucgaggccggacagaauacaaaauuuacccccgugggcguuuuccaagacggcgauaaccaccagaaugaaccccagcaaugggugcuuccuaacuacagcggggcgaccgcucauaauguccaccuggccccggccguggcucccgccuuuccuggagagcagcuccuguucuuuagauccacaaugcccggcuguagcggguacccuaacaugaaucuggacugccuccugccccaggaguggguucagcauuucuaucaagaagcugccccugcgcagucugauguggcccuucugcgguuugucaaccccgacaccuccagaguucucuucgaguguaagcugcacaaaagcggauacgugacaguggcucacacgggccagcaugaucuugucaucccgccuaacggguauuuccgcuuugacucuugggugaaucaguucuacacccuggcccccaugggcaacggaacaggccggagacgcgcucucuga

SEQ ID NO: 27294 - RNA, 1620 nt, Artificial Sequence
  derived and/or modified sequence opt5 from VP1__Norovirus__AHH44912
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuggagccuucgugguucagccccagaauggccgguguaccacagacggggugcuccugggaaccacgcaacuguccccugucaacauuugcacauuucgcggcgaucucacccauuucgcuggcacacacgaauacgcgaugaaucuggccagccagaacuggucuaauuaugaccccaccgaggaaaucccugcuccccuuggggccccggauuuugugggaaagaucagaggcguccugacccagacaacgcgcggggacggauccacccggggccauagagccacacucagcaccggguccgcucacuucacaccuaagcugggaucuauucgguuuagcaccgacacgaacaaugauuucgaggccggccagaacacaaaauuuacccccgugggcguuuuccaagacggggauaaucaccagaacgaaccccagcaaugggugcuuccuaauuacuccggagcgaccgcucauaacguccaccuggccccggccguggcucccgccuuuccuggcgagcagcuccuguucuuucgcagcacaaugcccggguguucuggauacccugacaugaaucuggauugccuccugccccaggaguggguucagcauuucuaucaagaagcugccccugcgcaguccgacguggcccuucugagauuugucaaccccgauaccagccggguucucuucgaguguaagcugcacaaaucuggcuacgugacaguggcucacacggggcagcaugaccuugucaucccgccuaauggcuauuucagauuugauagcugggugaaccaguucuacacccuggcccccaugggaaacggcacagggcgccggagagcucucuga

SEQ ID NO: 27295 - RNA, 1620 nt, Artificial Sequence
  derived and/or modified sequence opt5 from VP1__Norovirus__AHH44913
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacaucugaauacgcgaugaaucuggccucccagaacuggaccaauuaugaccccaccgaggaaaucccugcuccccuuggcgccccggauuuuguggggaagaucagaggaguccugacacagacgacccggcgcgacggcagcacaagagggcaccgggccacccucuccacaggaucugcucauuucaccccuaagcugggcagcauucgcuuuuccacggacacaaacaaugauuucgaggccgggcagaacaccaaauuuacccccgugggaguuuuccaagacggcgauaaucaccagaacgaaccccagcaaugggugcuuccuaauuacagcggcgcgacagcucacaacguccaucuggccccggccguggcucccgccuuuccuggggagcagcuccuguucuuuagaucuaccaugcccggauguuccggcuacccuaauaugaaccuggacugccuccugacacaggaguggguucagcacuucuaucaagaagcugcccccgcgcagagcgauguggcccuucugcgguuugucaauccugacacgucuagaguucucuucgaguguaagcugcauaaaagcggguacgugaccguggcucacacaggacagcacgaucuugucauucccccgaacggcuauuuccgcuuugacuccugggugaaccaguucuacacccuggccccuauggggaauggcacaggacggagacgcgcucucuga

SEQ ID NO: 27296 - RNA, 1620 nt, Artificial Sequence
  derived and/or modified sequence opt5 from VP1__Norovirus__AHH44914
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacacacgaauacgcgaugaaucuggccucucagaacuggaccaauuaugaccccaccgaggaaaucccugcuccccuuggcgccccggauuuuguggggaagaucagaggaguccugacacagacgacccggggcgacggguccacacgcggacauagagccacccucagcacaggcuccgcucacuucaccccuaagcuggggucugugcgguuuagcacggacacaaacaaugauuucgaggccggacagaacaccaaauuuacccccguuggcguguuccaagacggcgauaaucaccagaacgaaccccagcaauggguccuuccuaauuacuccggggcgacagcucauaacgugcaccuggccccggccguugcucccgccuuuccuggagagcagcuccuguucuuucgcagcaccaugcccggcuguucuggguacccuaauaugaaccuggacugccuccugccccaggagugggugcagcauuucuaucaagaagcugccccugcgcaguccgaugucgcccuucugagauuugugaaucccgacacaagccggguucucuucgaguguaagcugcacaaaucuggauacgugacggucgcucacaccggccagcaugaucuugugauuccgccuaacggguauuucagauuugacagcugggugaaccaguucuacacacuggcccccaugggcaauggaaccggccgccggagagcucucuga

SEQ ID NO: 27297 - RNA, 1620 nt, Artificial Sequence
  derived and/or modified sequence opt5 from VP1__Norovirus__AHH44915
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaggaccccacaaucaaacucauugccaugcuguauacaccccuucgcgcuaauaacgccggcgaagauguguucaccguguccugcagaguccugacccggccuagcccggacuuugauuucaucuuucucgugcccccuacaguugagucucgcuccaagcccuucaccgugccuauucugacggucgaagagaugaccaacagcagauuucccaucccgcuugagaaacuguucacagggccuucuuccgccuucgugguucagccccagaauggacgguguaccacagacggcgugcuccuggggaccacgcaacugagcccugucaacauuugcacauuucgcggagaucucacccauuucgcuggcacaucugaauacgcgaugaaucuggccucccagaacuggaccaauuaugaccccaccgaggaaaucccugcuccccuuggcgccccggauuuuguggggaagaucagaggaguccugacacagacgacccggcgcgacggcagcacaagagggcaccgggccacccucuccacaggaucugcucauuucaccccuaagcugggcagcauucgcuuuuccacggacacaaacaaugauuucgaggccgggcagaacaccaaauuuacccccgugggaguuuuccaagacggcgauaaucaccagaacgaaccccagcaaugggugcuuccuaauuacagcggcgcgacagcucacaacguccaucuggccccggccguggcucccgccuuuccuggggagcagcuccuguucuuuagaucuaccaugcccggauguuccggcuacccuaauaugaaccuggacugccuccugccccaggaguggguucagcacuucuaucaagaagcugccccugcgcagagcgauguggcccuucugcgguuugucaaucccgacacaucuagaguucucuucgaguguaagcugcauaaaagcggguacgugacgguggcucacaccggacagcacgaucuugucaucccgccuaacggcuauuuccgcuuugacuccugggugaaccaguucuacacacuggcccccauggggaauggcaccggacggagacgcgcucucuga

SEQ ID NO: 27298 - RNA, 1623 nt, Artificial Sequence; identical to SEQ ID NO: 27085
  derived and/or modified sequence opt5 from VP1__Norovirus__AID60853

SEQ ID NO: 27299 - RNA, 1623 nt, Artificial Sequence; identical to SEQ ID NO: 27133
  derived and/or modified sequence opt5 from VP1__Norovirus__AID60855

SEQ ID NO: 27300 - RNA, 1623 nt, Artificial Sequence; identical to SEQ ID NO: 27133
  derived and/or modified sequence opt5 from VP1__Norovirus__AID60857

SEQ ID NO: 27301 - RNA, 1623 nt, Artificial Sequence; identical to SEQ ID NO: 27133
  derived and/or modified sequence opt5 from VP1__Norovirus__AID60859

SEQ ID NO: 27302 - RNA, 1623 nt, Artificial Sequence
  derived and/or modified sequence opt5 from VP1__Norovirus__AID60861
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacaucggaagcgcugauuuugccccuaagcugggcagagugcaauucgagacggacacagaucaugacuuugaagccaaucagaacaccaaauucacccccguuggggugauucaggauggauccacaacccaccggaaugagccccaacaguggguccucccuagcuacucuggccgcaacacaccgaaugugcaccuggcucccgccguggcgccuacguuucccggcgaacagcuucuguucuuuagauccaccaugccuggguguagcggauaucccaacauggaccucgauugccugcugccucaggaguggguucaauacuucuaucaggaggcugcccccgcccagucugacgucgcucuccugcgguuugugaauccggauacaggcagagugcuuuucgaauguaagcugcauaaaagcggguacgucaccguggcccacacaggacagcaugaccucguuaucccucccaacggcuauuuucgcuucgauuccugggugaaucaauucuacacccuggcuccuauggggaacggcacgggacggagacgcgcccuuuga

SEQ ID NO: 27303 - RNA, 1623 nt, Artificial Sequence
  derived and/or modified sequence opt5 from VP1__Norovirus__AID60863
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaagccaaucagaacaccaaauucacacccguuggggugauccaggauggauccaccacacaccggaaugagccccaacaguggguccucccuagcuacucuggccgcaacacgccgaaugugcaccuggcucccgccguggcgccuaccuuucccggcgaacagcuucuguucuuuagauccacaaugccuggguguagcggauaucccaacauggaccucgauugccugcugccucaggaguggguucaauacuucuaucaggaggcugcccccgcccagucugacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauuccugggugaaucaauucuacacgcuggcuccuauggggaacggcaccggacggagacgcgcccuuuga

SEQ ID NO: 27304 - RNA, 1623 nt, Artificial Sequence
  derived and/or modified sequence opt5 from VP1__Norovirus__AID60865
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauguggugaucgacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaaaccaaucagaacacaaaauucacccccguuggggugauccaggauggaggcacaacgcaccggaaugagccccaacaguggguccucccuuccuacagcggccgcaacaccccgaaugugcaccuggcccccgcuguggccccuacauuucccggggaacagcuucuguucuuuagaucuaccaugccuggauguuccggcuaucccaacauggaccucgauugccugcugccucaggaguggguucaauacuucuaucaggaggcggcucccgcccagagcgacgucgcccuccugcgguuugugaauccggauacagggagagugcuuuucgaauguaagcugcauaaaucuggauacgucaccguggcucacacgggccagcaugaccucguuauuccucccaacggguauuuucgcuucgauagcugggugaaucaauucuacacccuggccccuaugggcaacggaacaggccggagacgcgcucuuuga

SEQ ID NO: 27305 - RNA, 1623 nt, Artificial Sequence
  derived and/or modified sequence opt5 from VP1__Norovirus__AID60869
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcucccacaauuacaccaugaaccucgcuagccagaauugguccaacuaugaucccaccgaggaaauuccugcgccccugggcacaccggacuucguugggaaaauccagggagugcuuacgcagaccacaagaaccaauggcucuacacgggggcauaaggccaccgucuacgcuggaagcgccaacuuugccccuaagcugggccgcgugcaauucgagacggacacagaucacgaccucgaagcuaaucagaacaccaaauuuacccccguuggggugauccaggauggaaauacaacccacagaaacgagccccaacaguggguccugccuuccuacagcggccggucuacaccgaaugugcaucuugcccccgcgguggcuccuacguuccccggcgaacagcugcucuuuuuccgcuccaccaugccuggguguagcggauaucccaacauggaccuggauugccugcucccucaggaguggguucaauacuuuuaucaggaggccgcccccgcucagucugacgucgcccugcuuagauucgugaauccggauacaggccgggugcuguuugaauguaagcuccacaaaagcggguacgucaccguggcucauacaggacagcacgaccugguuauuccucccaacggcuauuucagauuugauuccugggugaaccaauucuacacccuugccccuauggggaauggcacgggacgccggagagcgcuguga

SEQ ID NO: 27306 - RNA, 1623 nt, Artificial Sequence
  derived and/or modified sequence opt5 from VP1__Norovirus__AID60871
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccacaccgcuugagaagcuguucaccgggccuucuuccgccuucgugguccagccccagaacggacgguguacaaccgauggcgugcuccuggggacgacacaacugagcccugucaauaucugcaccuuucgcggagacgugacacauauuaccggcucuagaaacuacaccaugaaucucgcuucccagaacuggagcaauuaugaucccacagaggaaaucccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucaugacuuugaagccaaccagaauacaaaauucacccccguuggggugauccaggauggaagcacaacgcaccggaacgagccccaacaguggguccucccuuccuacagcggccgcaauaccccgaacgugcaccuggcucccgccguggcgccuacauuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacgggacagcaugaccucguuaucccucccaauggcuauuuucgcuucgauagcugggugaaccaauucuacacccuggcuccuauggggaacggcacaggacggagacgcgcccuuuga

SEQ ID NO: 27307 - RNA, 1623 nt, Artificial Sequence
  derived and/or modified sequence opt5 from VP1__Norovirus__AID60875
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacacaggaagcgcugauuuugccccgaagcugggcagagugcaauucgagaccgacaccgaucaugacuuugaaacaaaccagaauaccaaauucacaccuguuggggugauccaggauggauccacgacccaccggaacgagccccaacaguggguccuccccagcuacucuggccgcaauacaccuaacgugcaccuggccccggcuguggcccccaccuuuccuggcgaacagcuucuguucuuuagauccacaaugcccggguguagcggauauccuaauauggaccucgauugccugcugccccaggaguggguucaauacuucuaucaggaggcggcuccugcccagucugacgucgcccuccugcgguuugugaaccccgauaccggcagagugcuuuucgaauguaagcugcauaaaagcggguacgucacgguggcucacaccggacagcaugaccucguuaucccgccuaauggcuauuuucgcuucgaguccugggugaaccaauucuacacacuggcccccauggggaacggcaccggacggagacgcgcucuuuga

SEQ ID NO: 27308 - RNA, 1623 nt, Artificial Sequence
  derived and/or modified sequence opt5 from VP1__Norovirus__AID60877
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacacaggaagcgcugauuuugccccgaagcugggcagagugcaauucgagaccgacaccgaucaugacuuugaaacaaaccagaauaccaaauucacaccuguuggggugauccaggauggauccacgacccaccggaacgagccccaacaguggguccuccccagcuacucuggccgcaauacaccuaacgugcaccuggccccggcuguggcccccaccuuuccuggcgaacagcuucuguucuuuagauccacaaugcccggguguagcggauauccuaauauggaccucgauugccugcugccccaggaguggguucaauacuucuaucaggaggcggcuccugcccagucugacgucgcccuccugcgguuugugaaccccgauaccggcagagugcuuuucgaauguaagcugcauaaaagcggguacgucacgguggcucacaccggacagcaugaccucguuaucccgccuaauggcuauuuucgcuucgauuccugggugaaccaauucuacacacuggcccccauggggaacggcaccggacggagacgcgcucuuuga

SEQ ID NO: 27309 - RNA, 1623 nt, Artificial Sequence; identical to SEQ ID NO: 27308
  derived and/or modified sequence opt5 from VP1__Norovirus__AID60879

SEQ ID NO: 27310 - RNA, 1623 nt, Artificial Sequence
  derived and/or modified sequence opt5 from VP1__Norovirus__AID60881
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacacaggaagcgcugauuuugccccgaagcugggcagagugcaauucgagaccgacaccgaucaugacuuugaaacaaaccagaauaccaaauucacaccuguuggggugauccaggauggauccacgacccaccggaacgagccccaacaguggguccuccccagcuacucuggccgcaauacaccuaacgugcaccuggccccggcuguggcccccaccuuuccuggcgaacagcuucuguucuuuagauccacaauccccggguguagcggauauccuaauauggaccucgauugccugcugccccaggaguggguucaauacuucuaucaggaggcggcuccugcccagucugacgucgcccuccugcgguuugugaaccccgauaccggcagagugcuuuucgaauguaagcugcauaaaagcggguacgucacgguggcucacaccggacagcaugaccucguuauuccgccuaauggcuauuuucgcuucgauuccugggugaaccaauucuacacacuggcccccauggggaacggcaccggacggagacgcgcucuuuga

SEQ ID NO: 27311 - RNA, 1623 nt, Artificial Sequence
  derived and/or modified sequence opt5 from VP1__Norovirus__AID60883
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccauuuccccucggaaugcgcccggagagauccuguggucugccccucuuggcccggaucugaaccccuaccucagccaccuggcucgcauguauaauggguacgccggaggcuucgaagugcaggucauucuugcuggcaacgccuuuacagcggggaaagugaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugacuccacaaucaagcucauugccaugcuguauacaccccuucgcgcuaacaacgccggcgaugacguguucaccgugagcugcagaguccugacccggcccucuccugauuuugaccucaucuuccuggugccgcccacaguugaaucccgcaccaaaccuuuuagcgugcccguccuuacgguggaggaaaugaccaauucuagauucccuacaccccuggagaagcucuuuaccgggccguccagcgccuucguugugcagccucagaacggacgguguacaaccgauggcguccugcuggggacgacacaacucucucccgugaauauuugcaccuuccgcggagacgucacacauaucaccggcuccagaaacuacaccaugaaucuggcuagccagaacugguccaauuaugauccuacagaggaaauucccgcgccucuuggcacgcccgacuuuguggggaaaauccagggaguucugacccagacaacccggacagacggcucuacccgcgggcacaaggccacgguguacacaggaagcgcugauuucgccccgaagcucggcagaguccaauuugagaccgacaccgaucaugacuucgaaacaaaccagaauaccaaauuuacaccuguggggguuauccaggauggauccacgacccaccggaacgagccccaacagugggugcugcccagcuacucuggccgcaauacaccuaacguccaccuugccccggcuguggcccccaccuucccuggcgaacagcugcucuuuuucagauccacaauucccggguguagcggauauccuaauauggaccuggauugccugcucccccaggagugggugcaauacuuuuaucaggaggcggcuccugcccagucugacguugcccugcuucgguucgucaaccccgauaccggcagagugcuguuugaauguaagcuccauaaaagcggguacgugacggucgcucacaccggacagcaugaccuggugaucccgccuaauggcuauuuccgcuuugauuccuggguuaaccaauucuacacacuugcccccauggggaacggcaccggacggagacgcgcucuguga

SEQ ID NO: 27312 - RNA, 1623 nt, Artificial Sequence; identical to SEQ ID NO: 27308
  derived and/or modified sequence opt5 from VP1__Norovirus__AID60885

SEQ ID NO: 27313 - RNA, 1623 nt, Artificial Sequence
  derived and/or modified sequence opt5 from VP1__Norovirus__AID60887
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccacaccgcuugagaagcuguucaccgggccuucuuccgccuucgugguccagccccagaacggacgguguacaaccgauggcgugcuccuggggacgacacaacugagcccugucaauaucugcaccuuucgcggagacgugacacauauuaccggcucuagaaacuacaccaugaaucucgcuucccagaacuggagcaauuaugaucccacagaggaaaucccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucaugacuuugaaacaaaccagaauaccaaauucacacccguuggggugauccaggauggaagcacgacccaccggaacgagccccaacaguggguccucccuuccuacagcggccgcaauacaccgaacgugcaccuggcccccgcuguggccccuaccuuucccggcgaacagcuucuguucuuuagaucuacaaugccuggguguuccggauaucccaauauggaccucgauugccugcugccucaggaguggguucaauacuucuaucaggaggcggcucccgcccagagcgacgucgcccuccugcgguuugugaacccggauaccggcagagugcuuuucgaauguaagcugcauaaaucuggguacgucacgguggcucacaccggacagcaugaccucguuaucccucccaauggcuauuuucgcuucgauagcugggugaaccaauucuacacacuggccccuauggggaacggcaccggacggagacgcgcucuuuga

SEQ ID NO: 27314 - RNA, 1623 nt, Artificial Sequence
  derived and/or modified sequence opt5 from VP1__Norovirus__AID60889
augaagauggccagcuccgacgcuaaccccugcgauggcucugccgcgaaucuggugccugaggucaacaaugaaguuauggcucucgagccgguggugggggccgccaucgcugcccccgucggaggccagcaaaacgugauugacccuuggaucagaaauaacuucguucaggcucccgggggagaauuuaccgugagcccucggaaugcccccggcgagauucugugguccgcgccucuugggccggaucugaaccccuaccucucucaccuggcccgcauguauaauggauacgcuggcggcuucgaaguccaggugauccuugccgggaacgcuuuuacagccggaaaaguuauuuucgcggccgugccucccaauuuuccuacggagggccugagccccucccaggucaccauguucccgcauaucgugguggacgucagacaacucgagccuguucugaucccccugccugaugugcggaacaauuuuuaucacuacaaccagucuaaugacagcacaauuaagcucaucgcuaugcuguauacaccccuucgcgccaacaacgcuggggaugacguguucaccgucuccuguagagugcugacccggcccagcccugauuuugacuucauuuuucucguuccgcccacaguggaaucucgcaccaaaccuuucuccguccccgugcugacgguugaggaaaugaccaauagcagauuuccuacaccccuugagaagcuguucaccggaccgucuuccgccuucgugguccagccucagaacggccggugcacaaccgauggggugcuccugggaacgacacaacugagccccgucaauaucuguaccuuucgcggcgacgugacacauauuaccggcucuagaaacuacaccaugaaucucgccucccagaacuggagcaauuaugauccuacagaggaaauccccgcuccucuggggacgcccgacuucguuggaaaaauucagggcgugcuuacccagacaacccggacagacggguccacccgcggacacaaggcgacggucuacaucggcucugccgauuuugcuccgaagcuggggagagugcaauucgagacagacaccgaucaugacuuugaaaccaaccagaauacaaaauucaccccuguuggagugauccaggauggcagcacaacgcaccggaacgagccccaacaguggguccuccccuccuacagcggccgcaauaccccuaacgugcaccuggccccggccguggcucccacauuuccuggggaacagcuucuguucuuuagaucuacccuccccggaugcuccggcuauccuaauauggaccuggauugucugcucccccaggaguggguucaauacuucuaucaggaggccgcgccugcucagagcgacgucgcccugcuucgguuugugaaccccgauacagggagagugcuguucgaaugcaagcuccauaaaucuggauacgucaccguggcccacacgggccagcaugaccugguuauuccgccuaauggguauuuucgcuucgauagcugggugaaccaauucuacacccuugcucccaugggcaacggaacaggccggagacgcgcccuguga

SEQ ID NO: 27315 - RNA, 1623 nt, Artificial Sequence
  derived and/or modified sequence opt5 from VP1__Norovirus__AID60893
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuacaccccuugagaagcuguucaccgggccguccagcgccuucgugguccagccucagaacggacgguguacaaccgauggcgugcuccuggggacgacacaacugucucccgucaauaucugcaccuuucgcggagacgugacacauauuaccggcuccagaaacuacaccaugaaucucgcuagccagaacugguccaauuaugauccuacagaggaaauccccgcgccucugggcacgcccgacuucguugggaaaauucagggagugcuuacccagacaacccggacagacggcucuacccgcgggcacaaggccacggucuacaucggaagcgcugauuuugccccgaagcugggcagagugcaauucgagacagacaccgaucaugacuuugaaaccaaccagaauacaaaauucaccccuguuggggugauccaggauggauccacaacgcaccggaacgagccccaacaguggguccuccccagcuacucuggccgcaauaccccuaacgugcaccuggccccggcuguggcccccacauuuccuggcgaacagcuucuguucuuuagauccacccuccccggguguagcggauauccuaauauggaccuggauugccugcucccccaggaguggguucaauacuucuaucaggaggcggcuccugcccagucugacgucgcccugcuucgguuugugaaccccgauacaggcagagugcuguucgaauguaagcuccauaaaagcggguacgucaccguggcucacacgggacagcaugaccugguuauuccgccuaauggcuauuuucgcuucgauuccugggugaaccaauucuacacccuugcccccauggggaacggcacaggacggagacgcgcucuguga

SEQ ID NO: 27316 - RNA, 1623 nt, Artificial Sequence
  derived and/or modified sequence opt5 from VP1__Norovirus__AID68577
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucgggacuuugaagccaaccagaauaccaaauucacacccguggggguuauccaggauggaagcaccacacaucgcaacgagccccaacagugggugcucccuuccuacagcggcagaaauacgccgaacguccaccuggcucccgccguggcgccuaccuuucccggcgaacagcuucuguucuuucggucuacaaugccuggguguuccggauaucccaauauggaccucgauugccugcugccucaggagugggugcaauacuucuaucaggaggcugcccccgcccagagcgacguugcucuccugagauuugucaacccggauaccggccgcgugcuuuucgaauguaagcugcacaaaucuggguacgugacagucgcccauaccggacagcacgaccucgugauuccucccaauggcuauuuucgguucgauagcuggguuaaccaauucuacacgcuggcuccuauggggaacggcaccggaagacgccgggcccuuuga

SEQ ID NO: 27317 - RNA, 1623 nt, Artificial Sequence
  derived and/or modified sequence opt5 from VP1__Norovirus__AID68578
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuuucuccuaagcugggccgcauccaauucgagacagacaccaaucacgauuuugaagccaaccagaauaccaaauucacacccguggggguuauucaggacggaggcaccacacacagaaacgagccccaacagugggugcucccuagcuacuccggccggaauacgccgaacguccaucuggcccccgcuguggccccuaccuuucccggggaacagcuucuguucuuucgcagcacaaugccuggauguucuggcuaucccaauauggaucucgacugccugcugccucaggagugggugcaauacuucuaucaggaggcggcucccgcccaguccgauguugcccuccugagauuugucaacccggacaccgggcgggugcuuuucgaauguaagcugcacaaaagcggauacgugacagucgcucauaccggccagcacgaucucgugaucccucccaacggguauuuuagauucgacucuuggguuaaucaauucuacacgcuggccccuaugggcaacggaaccggccgccggagagcucuuuga

SEQ ID NO: 27318 - RNA, 1623 nt, Artificial Sequence
  derived and/or modified sequence opt5 from VP1__Norovirus__AID68579
augaagauggccagcuccgacgcuaaccccucugauggcagcgccgcgaaucuggugccugaggucaacaaugaaguucucgcucuggagccgguggugggggccgccaucgcugcccccgucgcuggacagcaaaacgugauugacccuuggaucagaaauaacuucguucaggcccccggcggggaauuuaccguguccccucggaaugcgcccggagagauucuuuggucugccccucugggcccggaucucaaccccuaccugagccaccuugcucgcauguauaauggguacgccggaggcuucgaaguccaggugauccuggcuggcaacgccuuuacagcggggaaaguuauuuucgccgcugugccucccaauuuuccuacggagggacucucccccucucaggucaccauguucccgcauaucgugguggacgucagacaacuggagccuguucugaucccccucccugaugugcggaacaauuuuuaucacuacaaccagagcaaugaccccacaauuaagcugaucgccaugcuuuauacaccccugcgcgcuaacaacgccggcgaugacguguucaccgucuccugcagagugcucacccggccuagcccggauuuugacuucauuuuucugguucccccuacaguggaaucucgcaccaaacccuucuccgucccugugcuuacgguugaggaaaugaccaauagcagauuucccaucccgcuggagaagcuguucacagggccuucuuccgccuucgugguccagccccagaacggacgguguaccacagauggcgugcugcuggggaccacgcaacucagcccugucaauauuugcacauuucgcggagacgugacccauaucacaggcucucacaacuacaccaugaaucuggcuucccagaacuggaauaacuaugaucccaccgaggaaauuccugcgccccuuggcacaccggacuucguugggaaaauccagggagugcugacgcagaccacaagaaccgacggcagcacacgggggcauaaggccaccgucuacacgggauccgcugauuuuucuccuaagcucggccgcauccaauucgagacagacaccaaucacgauuuugaagccaaccagaauaccaaauucacacccguggggguuauucaggacggaggcaccacacacagaaacgagccccaacagugggugcugccuagcuacuccggccggaauacgccgaacguccaucuugcccccgcuguggccccuaccuuucccggggaacagcuccucuucuuucgcagcacaaugccuggauguucuggcuaucccaauauggaucuggacugccugcucccucaggagugggugcaauacuucuaucaggaggcggcucccgcccaguccgauguugcccugcuuagauuugucaacccggacaccgggcgggugcuguucgaauguaagcuccacaaaagcggauacgugacagucgcucauaccggccagcacgaucuggugaucccucccaacggguauuuuagauucgacucuuggguuaaucaauucuacacgcuugccccuaugggcaacggaaccggccgccggagagcucuguga

SEQ ID NO: 27319 - RNA, 1623 nt, Artificial Sequence; identical to SEQ ID NO: 27141
  derived and/or modified sequence opt5 from VP1__Norovirus__AID68581

SEQ ID NO: 27320 - RNA, 1623 nt, Artificial Sequence
  derived and/or modified sequence opt5 from VP1__Norovirus__AID69174
augagaauggccagcgacgaugcuaaguccgcccccucugaccuggagggcgcggggcucgugccugcuaccgccgccccgcugcccgucgcuccuguugccggagcucaggccgcggaacccuucgccggccaaaucaacgugauugauccuuggaucuacacaaauuuugugcaggcucccacgggggaguucaccgucagcccucggaacacaccgggagaagugcuuguuaaucuggagauuggccccaaccucaauccuuaucugcagcaccuugcccagauguacaacggguaugcuggaggcguggaaguccaagugauccuggccggcaaugcguuuaccgccgggaaacuccugugcgcucugguucccccuggauuccccacauccucuauuaccccggcccagcucacaaugcugccucauaccaucaucgacgugcgcacgaccgaucccgucguggugccuaugcccgacgucagacggacacuuuggcacgagguucgcagcaccacagagccccugaugagacucgugauuaugcuguacaccccuaugcgggcuaacuccggcucugaugaagccuuuguggucagcgggcgcgugcuuuccagaccggcccccgacuucaacuuuuucuaucugguuccuccccggguggaggauacggucgaaccuuuuagccuccccgaccugcgcguggaugagaugucuuccagcagauggcagaauccgguugugaugcugcaggcugacccuaaucaaaacaucgcggcccauuggcagaauggacgguguacaauuaacggcgagcuccuggggaccacaccccgcaaucagucuuggcuucugagaaugcggggauccguccucgcugccccuggcggccagaaggccgugaccgucaacguggaucugaccgaacccgacgggcaggcuuucagcguucuuucuggaaacccuggccccgagggggugccggacuuucaggccaucuacaauguccgcauguccacagcgagcacgaccgcuggacacacaguggccaccaacggcuauauugaacaguccggguacaccccugcccugggaacacucguuauccaaggcguggaucugucucagguccccgcucugggcagcgaggugacgaugcaagugguuuccauugaccucaaucauaacauggaucccacaagacugccugacuacaauggggccggauucgauggcagcgucgcucuugccccgccccuggugccuccccucccuggggaagugcugcuucgguuuaccacccugcccaucacaaccucuagaggauccagcgucucugcgacacucgacugcgcccugccugcugaguggaucacgugguuccuggugcacaacuucguuccccagggcgaugccgcucuccugcgcuaucggaauagagggaccggccaaauucuuuuugaguguaaacuguacaaggaaggauuccucgccguggcgggcgucagcacacgcaccguguuuccgacauccgggguuuucgaguuugugucuugggucccuguguucuaucagcugacccccguuggaagcuccggcgcccggaaaagacagcgcuga

SEQ ID NO: 27321 - RNA, 1623 nt, Artificial Sequence
  derived and/or modified sequence opt5 from VP1__Norovirus__AIG59994
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacaucggauccgcugauuuugccccuaagcugggcagagugcaauucgagacggacacagaucaugacuuugaagccaaucagaacaccaaauucacccccguuggggugauucaggauggaggcacaacccaccggaaugagccccaacaguggguccucccuucuuacagcggccgcaacacacacaaugugcaucuggcuccggccguggcgcccacguuuccuggggaacagcuucuguucuuuagauccaccaugcccggauguagcggcuauccuaacauggaccucgauugccugcugccccaggaguggguucaauacuucuaucaggaggcugccccugcccagucugacgucgcucuccugcgguuugugaaucccgauacagggagagugcuuuucgaauguaagcugcacaaauccggauacgucaccguggcccauacaggccagcacgaccucguuaucccgccuaacggguauuuucgcuucgauagcugggugaaccaauucuacacccuggcucccaugggcaauggaacgggccggagacgcgccgucuga

SEQ ID NO: 27322 - RNA, 1623 nt, Artificial Sequence
  derived and/or modified sequence opt5 from VP1__Norovirus__AIG59996
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauucaggauggaggcaccacacaccggaaugagccccaacagugggugcucccuucuuacagcggccgcaacacgcacaauguccaucuggcuccggccguggcgcccaccuuuccuggggaacagcuucuguucuuuagauccacaaugcccggauguagcggcuauccuaacauggaccucgauugccugcugccccaggagugggugcaauacuucuaucaggaggcugccccugcccagucugacguugcucuccugcgguuugucaaucccgauaccgggagagugcuuuucgaauguaagcugcacaaauccggauacgugacagucgcccauaccggccagcacgaccucgugaucccgccuaacggguauuuucgcuucgauagcuggguuaaccaauucuacacgcuggcucccaugggcaauggaaccggccggagacgcgccguguga

SEQ ID NO: 27323 - RNA, 1623 nt, Artificial Sequence; identical to SEQ ID NO: 27085
  derived and/or modified sequence opt5 from VP1__Norovirus__AIG59998

SEQ ID NO: 27324 - RNA, 1623 nt, Artificial Sequence
  derived and/or modified sequence opt5 from VP1__Norovirus__AIG60000
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaaugggcaugccggaggcuucgaaguccaggugauccuugcuggcaacgccuuuacagcggggaaaguuauuuucgccgcugugccucccaauuuuccuacggagggacugucccccucucaggucaccauguucccgcacaucgugguggacgucagacaacucgagccuguucugaucccccugccugaugugcggaacaauuuuuaccauuauaaccagagcaaugaccccacaauuaagcucaucgccaugcuguacacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccacaucacaggcucuagaaacuauaccaugaaucucgcuucccagaacuggaauaacuacgaucccaccgaggaaauuccugcgccccugggcacaccggacuucguugggaaaauccagggagugcuuacgcagaccacacggaccgacggcagcacacgcgggcauaaggccaccgucuauacgggauccgcugauuuugccccuaagcugggcagagugcaauucgagacagacaccgaucacgacuuugaagccaaucagaacaccaaauucacacccguuggggugauccaggauggaggcaccacacaccggaaugagccccaacaguggguccucccuucuuacagcggccgcaacacgcauaaugugcaccuggcuccggccguggcgcccaccuuuccuggggaacagcuucuguucuuuagauccacaaugcccggauguagcggcuacccuaacauggaccucgauugccugcugccccaggaguggguucaauauuucuaccaggaggcugccccugcccagucugacgucgcucuccugcgguuugugaaucccgauaccgggagagugcuuuucgaauguaagcugcauaaauccggauaugucacaguggcccacaccggccagcacgaccucguuauuccgccuaacggguacuuucgcuucgauagcugggugaaccaauucuauacgcuggcucccaugggcaauggaaccggccggagacgcgccgucuga

SEQ ID NO: 27325 - RNA, 1623 nt, Artificial Sequence
  derived and/or modified sequence opt5 from VP1__Norovirus__AIG60002
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagcugugacccauaucacaggcucuagaaacuacaccaugaaucucgcgucccagaacuggagcaauuaugaccccaccgaggaaauuccugcuccccugggcacaccggauuucguugggaaaauccagggagugcuuacgcagaccacacggaccgacggcuccacacgcgggcacaaggccaccgucuacacgggaucugccgacuuugccccuaagcugggcagagugcaauucgagacagauaccgaccgggauuuugaagcuaaccagaauaccaaauucacacccguuggggugauccaggacggaagcaccacacaucgcaacgagccccaacaguggguccucccuuccuacagcggcagaaauacgccgaacgugcaccuggcccccgcgguggcuccuaccuuucccggcgaacagcuucuguucuuucggucuauuaugccuggguguuccggauaucccaauauggaucucgacugccugcugccucaggaguggguucaauacuucuaucaggaggccgcccccgcucagagcgaugucgcccuccugagauuugugaacccggacacaggccgcgugcuuuucgaauguaagcugcacaaaucuggguacgucaccguggcucauacaggacagcacgaucucguuaucccucccaauggcuauuuucgguucgacagcugggugaaccaauucuacacccuggccccuauggggaacggcacgggaagacgccgggcgcuuuga

SEQ ID NO: 27326 - RNA, 1623 nt, Artificial Sequence; identical to SEQ ID NO: 27085
  derived and/or modified sequence opt5 from VP1__Norovirus__AIG60004

SEQ ID NO: 27327 - RNA, 1623 nt, Artificial Sequence; identical to SEQ ID NO: 27085
  derived and/or modified sequence opt5 from VP1__Norovirus__AIG60006

SEQ ID NO: 27328 - RNA, 1623 nt, Artificial Sequence
  derived and/or modified sequence opt5 from VP1__Norovirus__AIG60008
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcgcccuuuga

SEQ ID NO: 27329 - RNA, 1623 nt, Artificial Sequence; identical to SEQ ID NO: 27139
  derived and/or modified sequence opt5 from VP1__Norovirus__AIG60010

SEQ ID NO: 27330 - RNA, 1623 nt, Artificial Sequence; identical to SEQ ID NO: 27085
  derived and/or modified sequence opt5 from VP1__Norovirus__AIG60012

SEQ ID NO: 27331 - RNA, 1623 nt, Artificial Sequence
  derived and/or modified sequence opt5 from VP1__Norovirus__AIG60014
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggagacgcgccgucuga

SEQ ID NO: 27332 - RNA, 1623 nt, Artificial Sequence; identical to SEQ ID NO: 27133
  derived and/or modified sequence opt5 from VP1__Norovirus__AIG60016

SEQ ID NO: 27333 - RNA, 1623 nt, Artificial Sequence; identical to SEQ ID NO: 27085
  derived and/or modified sequence opt5 from VP1__Norovirus__AIG60018

SEQ ID NO: 27334 - RNA, 1623 nt, Artificial Sequence
  derived and/or modified sequence opt5 from VP1__Norovirus__AIG60020
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcaucgugcaauucgagacagacaccgaucaugacuuugaagccaaccagaauaccaaauucacacccguuggggugauucaggauggaagcaccacacacagaaacgagccccaacaguggguccucccuuccuacagcggccggaauacgccgaacgugcaccuggcucccgccguggcgccuaccuuucccggcgaacagcuucuguucuuucgcucuacaaugccuggguguuccggauaucccaauauggaccucgauugccugcugccucaggaguggguucaauacuucuaucaggaggcugcccccgcccagagcgacgucgcucuccugagauuugugaacccggauaccggccgggugcuuuucgaauguaagcugcauaaaucuggguacgucacaguggcccacaccggacagcaugaccucguuaucccucccaauggcuauuuuagauucgauagcugggugaaccaauucuacacgcuggcuccuauggggaacggcaccggacgccggagagcccuuuga

SEQ ID NO: 27335 - RNA, 1623 nt, Artificial Sequence; identical to SEQ ID NO: 27085
  derived and/or modified sequence opt5 from VP1__Norovirus__AIG60022

SEQ ID NO: 27336 - RNA, 1623 nt, Artificial Sequence; identical to SEQ ID NO: 27139
  derived and/or modified sequence opt5 from VP1__Norovirus__AIG60024

SEQ ID NO: 27337 - RNA, 1629 nt, Artificial Sequence
  derived and/or modified sequence opt5 from VP1__Norovirus__AII73717
augaagauggccagcaacgacgcugcccccuccaaugauggcgcggcuucucuggugccugaggggaucaacgaaaccaugccgcucgagcccgucgccggagccagcauugcugccccuguugcuggccagacaaauaucauugaccccuggaucagaacgaacuucgugcaagccccuaauggggaauuuaccgugucccccagaaacucuccuggagagauucugcuuaaucuggaacucggcccggaucugaaccccuaccuugcgcaccugagccgcauguauaauggguacgccggaggcgucgaggugcagguucuccuggcuggcaacgccuucacagcugggaaaauccuguuugccgcgaucccucccaauuucccuguggacaugauuucccccgcccagaucaccaugcucccgcaucugauugucgaugugagaacacuugagccuaucaugauuccccugccugacguucggaacguguuuuaucacuucaauaaccagccccaaccccgcaugagacucgucgcuaugcuguacaccccucuucggucuaauggaagcggcgaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcccccaacgagacgaaugugguccagugucagaacgggcgcugcacacuugacggagaacugcaaggcaccacacagcuccugucuuccgcuguguguagcuauagagggcggaccguugccaauaacggagauaauugggaccagaaccuucugcagcucaccuacccuaauggcgccucuuacgaucccacagacgaggugccugcuccccugggcacgcaagacuucuccgggaugcuguauggaguccucacccaggauaacgugaauguuagcacaggcgaagcgaagaacgccaaagggaucuacauuuccaccacaucuggaaaguuuaccccgaagaucggcagcauugggcugcauuccaucacggagcacgugcauccuaaucagcaaagccgcuucacacccgucggaguggcugucaacgaaaauacccccuuccagcagugggugcuuccucacuaugccggcucucuggcccucaacaccaaucuggcuccggccguugcgcccacauuuccuggcgagcagcuucuguucuuuagaucccgggugcccugcguccaagggcuccagggacaggacgcuuucaucgauugucugcugccucaggagugggugaaccacuuuuaccaagaagccgcccccagccaggcugacguugcccucauucgcuaugugaacccugauaccggcagaacacuguucgaggcuaaacuucaucggucuggguuuaucacggucagccacaccggagccuacccccugguggugccgccuaauggccauuucagauuugacuccuggguuaaccaguucuauucucucgcgcccauggggacaggcaauggacgccggcggauucaguga

SEQ ID NO: 27338 - RNA, 1623 nt, Artificial Sequence
  derived and/or modified sequence opt5 from VP1__Norovirus__AII73720
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuucccagaucacaauguuuccccauguuaucguggaugucagaacccuggagccggugcuccugccuaugcccgacgugcggucuacacuuuuccacuuuaaucagaaggaugaaccuaaaaugcgccuggucgccaugcucuacacgccccugagaagcaacggauccggcgacgauguuuucaccgugagcugccggauucuuacccgccccucuccugaguuugacuucacauaucuggugccgcccaccgucgaguccaagacaaaaccuuuuacccuccccgugcugacgcugggggaacucagcaauucuagauucccucuguccaucgaugagaugguuacaagccccaacgaaucuauugugguccaaccgcagaacggacgggugacccuugacggcgagcugcucgggacaacccagcugcaggcuuguaauaucugcuccauucgcggaaagguuaccggccaagugccuaacgaacagcauauguggaaucuugagaucacaaaccugaauggcacgcaguuugaucccaccgacgaugucccugcuccccucggggugccugacuucgccggagaggucuucggcgugcugagccagagaaaccgcggggaauccaaucccgccaaccgggcccacgacgcuguuguggcgacauacucugauaaguauaccccgaaacugggacucguccaaauuggcacauggaauaccaacgacguggagaaucagccuacgaaguuuacacccaucgggcugaacgaaguugccaauggacauagauucgagcaguggacccuuccccgguacagcggcgcucugacccucaacaugaaucuggccccugccguggcuccgcuuuuucccggcgaacgccuccuguucuuuagauccuacgucccucugaaagggggauucggcaaccccgccaucgauugucuggugccucaagagugggugcagcacuuuuaucaggagagcgcgcccucucucggggacguugcucugguccgguacgugaacccugauacaggaagagugcuuuucgaagccaagcugcacaaaggcggguuucucaccgucuccagcacaucuacgggccccgugguugugccggccaauggauauuuccgcuuugacagcugggucaaccaguucuacucccuggcuccuaugggcaccgggaauggacggagacgcuuucaauga

SEQ ID NO: 27339 - RNA, 1611 nt, Artificial Sequence
  derived and/or modified sequence opt5 from VP1__Norovirus__AII73723
augaagauggccagcaacgacgcuacccccuccgaugacggcgccgcggggcuggugccugagaucaauucugaagucauggcucucgagccgguugccggagccagcauugcugcccccguggugggccagcaaaacaucauugauccuuggaucagaaauaacuucguccaggcucccgccggggaauuuacaguguccccucgcaauucucccggagagcugcuucuggaccucgaacugggcccugagcuuaacccguaccuggcgcaccucgcccggauguauaaugggcaugcuggaggcauggagguucagauugugcuggccggcaacgcuuucacggccgggaaaauccuguuugcggccauucccccuagcuuccccuacgaaaaucucuccccugcucagcugaccaugugcccccacgucaucguggauguuagacaacuugagccggugcugcucccuaugcccgacauccggaacgucuuuuaucauuacaaucagaacaauucuccuaagcugcgccuuguggccaugcuguauacaccccucagagcuaacaauagcggagaugacguguucaccgucuccugucggguucugacacgccccagcccugauuuucaguucaccuuucuggugccgcccacaguggaaucuaaaaccaagaacuucacgcucccuguccugagaguguccgagaugaccaacagccgguuucccguugugcuugaccagauguacacaucucgcaaugagaacauuaucguccaaccucagaauggcagaugcaccacagauggggaacugcucggaaccacgauucugcaguccgugagcaucuguaacuucaaaggcacaaugcaggccaaacuuaaugaggaaccccgguaucaacugcagcucaccaaccuggacgggucuccgauugauccuacagacgacaugcccgccccucugggaacccccgauuuucaggcuguucucuacggcguggcgucccaacgcagcuccagagacaaugccacccgggcucacgaugcccagaucgacacagccggcgauacguucgcuccuaagaucgggcagguccgcuucaagucuagcuccaacgacuuugaucugcaugaccccaccaaguucacaccgauuggagugaaugucgaugaccagcacccuuuuagacaauggagccuucccaacuacggcgggcaccuggcccucaauaaccaucuggcgcccgcugugaccccucuuuucccgggagagcagauccuguuuuuccggucuuauauucccuccgccggcgggcacacagauggagccauggacugccuccugccucaggaauggguugagcauuuuuaccaggaggcugcccccagccaaucugacaucgcucuggugagauucauuaauccugauaccggccgcguccucuuugaagccaaacugcacaagcagggcuuccuuacgaucgcggccagcggggaccaccccaucgugaugccuacaaacggauauuuucgguucgaggcuuggguuaaucccuuuuacacccuggccccggugggcaccggguccggaagacgccggauucaguga

SEQ ID NO: 27340 - RNA, 1623 nt, Artificial Sequence; identical to SEQ ID NO: 27085
  derived and/or modified sequence opt5 from VP1__Norovirus__AII73726

SEQ ID NO: 27341 - RNA, 1623 nt, Artificial Sequence; identical to SEQ ID NO: 27085
  derived and/or modified sequence opt5 from VP1__Norovirus__AII73729

SEQ ID NO: 27342 - RNA, 1623 nt, Artificial Sequence; identical to SEQ ID NO: 27085
  derived and/or modified sequence opt5 from VP1__Norovirus__AII73732

SEQ ID NO: 27343 - RNA, 1608 nt, Artificial Sequence
  derived and/or modified sequence opt5 from VP1__Norovirus__AII73735
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccauucuuacaaucggagagcugaccaacucccgguucccuguccccauugaugaacucuacacaagcccgaaugagucucuggugguucagccucagaacggccgcugugcccuugacggggaacugcagggaaccacgcaacuccugcccacagcuaucugcuccuuuagaggccggauuaaucagaaggugagcggcgagaaccacgucuggaauaugcaggucaccaacaucaaugggacaccuuucgaucccaccgaagacguuccugcuccccugggaaccccggauuucucuggcaaacucuuuggggugcuguccccucgcgaccaugacaacgccuguagaagccacgaugccgucauugcgacaaauuccgccaaguucacgcccaaacuuggagcuauccagaucggcaccugggaggagaacgacgugcacauuaaucaacccacaaaguuuaccccugucgggcuguucgaagaugagggauuuaaccaguggacacucccgaauuauucuggcgcccugacccuuaacaugggccuggcucccccuguggcccccacguucccuggggaacagauccucuuuuuccggagccauauuccccugaagggaggcguugccgacccugugaucgauugccugcucccccaagaguggauucagcaccuguaccaggaauccgcgccgagccagucugacgucgcucuuauccgcuuuacaaacccugauaccgggagagugcuguucgaggccaaacuccaucgguccggauacaucaccguugccaauacaggcagcagacccauuguggucccugcuaacggguauuuucgcuucgacucuugggugaaucaauuuuacagccuggcccccaugggcaccggaaacggccggagacgcgugcaguga

SEQ ID NO: 27344 - RNA, 1623 nt, Artificial Sequence; identical to SEQ ID NO: 27139
  derived and/or modified sequence opt5 from VP1__Norovirus__AII73738

SEQ ID NO: 27345 - RNA, 1620 nt, Artificial Sequence
  derived and/or modified sequence opt5 from VP1__Norovirus__AII73741
augaagauggccagcaacgacgcugcccccuccaaugauggcgcgaccgggcuggugccugagaucaacacagaaacgcucccgcuggagcccgucgcuggagccgccauugcugccccuguuaccggccagaauaacaucauugaccccuggaucagaaauaacuucgugcaagcuccuaauggggaauuuacagugucuccccggaacagcccuggagagauucuuaugaaucuggaacucggcccggaucugaaccccuaccuugcccaccugucccgcauguauaauggguacgcgggaggcgucgaggugcagguucuccuggccggcaacgcuuucaccgccgggaaaauccuguuugcugccgugccucccaauuucccugucgacaugcucucucccgcgcagaucacaaugcugccgcaucuuauuguggauguuagaacccuggagccuaucaugauuccccucccugacgugcggaacgucuuuuaucacuucaauaaccagcccgcuccccgcaugagacugguggccaugcuuuacacaccucugcggagcaacggauccggcgaugacguguuuaccgucucuugccgcguucucacgagaccgacccccgauuucgaauuuacauaucuggugccucccagcguggaguccaagaccaaaccuuucacacugcccauccucaccauuggggaacugacgaauagccgguuuccggccccuaucgaccaacuuuacacaucucccaacgcugauauugucgugcagccucagaauggacgcuguacccuggacggcgagcuccaggggacaacccaacugcuuaccacagccaucugcuccuauagaggaaugacgagcaaccccaccucugauuacugggacgaccaucugcuccaccugguucauccuaauggcgccacauacgaucccaccgaggacgugccggcuccuuucggcacacaggauuuucgggggauccuguauggaaugcucacccagaacccccgcacguccggcgacgaagcggccaauagccacgggauuuacaucucuuccacaagcgagaaguucacccccaaacugggaaccauuggccuucaccagguccaaggggauaucgcuuccaaccagcagucuaaguucacaccugugggaauugccguuaauggcaacaccccguuuagacaaugggaacugcccaauuauagcggcgcccucacacugaacacgaaucuugcuccugccguggggcccaacuucccuggagagcagauccuguuuuuccgguccaauguccccagcgugcagggcgggcagccuaucgaaauugacugucucaucccccaagagugggucucucauuuuuaccaggaguccgcgccgagccagucugauguggcucugguucgcuaugugaacccugacaccggaagaacaauuuucgaagccaagcugcaccggcagggcuuuaucaccauugccgcuacagggagcaaccccgucgugguuccucccaauggcuacuucagauuugauuccugggugaaccaauucuaugcccucgcuccgaugggaaccggcaaugggcgccggagaguccaguga

SEQ ID NO: 27346 - RNA, 1623 nt, Artificial Sequence; identical to SEQ ID NO: 26482
  derived and/or modified sequence opt5 from VP1__Norovirus__AII73744

SEQ ID NO: 27347 - RNA, 1623 nt, Artificial Sequence
  derived and/or modified sequence opt5 from VP1__Norovirus__AII73747
augaagauggccagcaacgacgcugcccccuccaaugauggcgcgaccgggcuggugccugagaucaacaaugaaacacucccgcuggagcccgucgcuggagccgccauugcugccccuguuacgggccagaacaauaucauugaccccuggaucagaaccaacuucgugcaagcuccuaauggggaauuuacagugucuccccggaacagcccuggagagauucuucugaaucucgaacugggcccggaucuuaaccccuaccuggcccaccucucccgcauguauaauggguacgcgggaggcgucgaggugcagguucugcuggccggcaacgcuuucaccgccgggaaaauccucuuugcugccgugccucccaauuucccugucgaguuucugucucccgcgcagaucacaaugcuuccgcaucugauuguggacguuagaacccucgaaccuaucaugauuccccugccugaugugcggaacacauucuuucacuauaauaaccagcccgccaaccgcaugagacuugucgcuaugcuguacacgccccuccggagcaauggauccggcgacgauguguucaccgugucuugccgcguccugaccagaccuacaccggacuuugaguucaccuaucugguucccccuagcguggaauccaagacaaaacccuuuagccucccuauccugaccauuucugagcuuacgaacucccgguuccccgccccgaucgauagccuguuuacagcucaaaauaacaaucucaacgugcagugucagaaugggcgcugcacccuggacggagagcuucagggcacaacccaacugcucccuucugggauuugugccuucagaggacggcugaccgccgaugucgacggcucccaugaugaccgcuggcacaugcagcugacaaaccucaauggcacgcccuucgacccuaccgaagaugugcccgcuccucuggggacacccgacuuuaccggacuucuguucggcguugcgagccagagaaacguggggucuaauccgaacacaacccgggcccaugaggcugucaucuccacgacaagcucccaguuugugccuaagcucggaucuguuaauuucggcagcaccuccaccgauuuucaacugcagcagcccacaaaauucacccccguggggaucaagauugaaagcggacacgaguuugaccaaugggcccuuccucgcuacucuggccaccugacacucaacaugaaucuggccccgcccaucgcuccuaacuuccccggcgaacagcugcucuuuuucagauccaacgucccuugcgccgggggagugagcgauggcgucauugacugucugcuuccccaggaguggauccagcauuuuuaucaagagucugcgccuagccaguccgauguggcucugauucgguacguuaaucccgacacggggagaacccucuucgaagccaagcugcaccgcacaggauacaucaccguggcccauucuggcgauuauccgcuggucgugccuagcaacggguacuuucgguucgacuccuggguuaaucaguucuauagccuugcucccaugggcacaggaaacggcagacgccgggugcaguga

SEQ ID NO: 27348 - RNA, 1623 nt, Artificial Sequence
  derived and/or modified sequence opt5 from VP1__Norovirus__AII73750
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaaugggcaugcuggaggcuucgaaguccaggugauccuugccggcaacgcuuuuacggccgggaaaauuaucuucgcggccguuccucccaauuuuccuaccgagggacugucccccucucaggugacaauguucccgcacaucauugucgacgugagacaacucgagccugugcugaucccccugccugauguccggaacaauuuuuaccauuauaaccagagcaaugacuccaccauuaagcucaucgcuaugcuguacacaccccuucgcgccaacaacgcuggcgaagauguuuucaccgugagcugcagagugcugacacggcccucuccugacuuugauuucauuuuucucgucccgcccaccguggagucccgcacgaaaccuuucaccguucccauccugacaguggaagagaugaccaauagcagauuuccuauuccccuugagaagcuguucacagggccgucuuccgccuucgucgugcagccucagaacggacgguguaccacggacggcguucuccuggggacaacccaacugagccccgugaauaucugcacauuucgcggagaugucacccacaucgccggcucuagaaacuauaccaugaaucucgcuucccugaacuggaauaacuacgacccuacagaagagauucccgcgccucuuggcacgcccgauuucguggggaaaauccagggaguccugacccagacaaccaagggcgacgggagcacacggggacauaaggccaccguguauacgggcuccgcuccguuuacaccuaaacucgggucuguucaguucagcaccgacaccgaaaaugauuuugagacacaccaaaacaccaaguucacacccgugggagucauucaggacggcggcacgacccaccgcaaugaaccccagcaaugggugcugccuuccuacagcgggagaaacguucauaaugugcaccuugccccggccgucgcucccacauuuccuggagagcagcuccuguucuuucggucuaccaugcccggcuguuccggguacccuaacauggaucuggacugccugcucccccaggagugggugcagcauuucuaucaagaagccgcgccugcucagagcgauguggcccugcuucgcuuuguuaaucccgacacaggaagaguccuguucgaguguaaacuccacaagucuggcuacgugaccguggcccacacggggcagcaugaucuggucaucccgccuaacggcuauuuucgguucgacagcugggugaaccaguucuacacccuugcucccaugggaaauggcacagggagacgccgggcccuguga

SEQ ID NO: 27349 - RNA, 1623 nt, Artificial Sequence
  derived and/or modified sequence opt5 from VP1__Norovirus__AII73753
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuucccagaucacaauguuuccccauguuaucauugaugugagaacccuggagccgguccuccugccuaugcccgacgugcggucuacacuuuuccacuuuaaucagaaggaugaaccuaaaaugcgccugguggccaugcucuacacgccccugagaagcaacggauccggcgacgaugucuucaccguuagcugccggauccuuacccgccccucuccugaguuugacuucacauaucuggugccgcccaccguggaguccaagacaaaaccuuuuacccuccccguccugacgcugggggaacucagcaauucuagauucccucuguccauugaugagauggugacaagccccaacgaaucuaucguugugcaaccgcagaacggacgggucacccuugacggcgagcugcucgggacaacccagcugcaggcuuguaauauuugcuccauccgcggaaaggugaccggccaaguuccuaacgaacagcauauguggaaucuucagauuacaaaccugaauggcacgcaguuugaucccaccgacgaugugccugcuccccucggggucccugacuucgccggagagguguucggcguccugagccaaagaaaccgcggggaguccaaucccgccaaccgggcccacgacgcugugguugcgacauacucugauaaguauaccccgaaacugggacucgugcagaucggcacauggaauaccaacgacgucgaaaaucagccuacgaaguuuacacccaucgggcugaacgagguggccaauggacauagauucgaacaauggacccuuccccgguacagcggcgcucugacccucaacaugaaucuggccccugccguugcuccgcuuuuucccggcgagcgccuccuguucuuuagauccuacgugccucugaaagggggauucggcaaccccgccauugauugucuggucccucaggaaugggugcagcacuuuuaucaggagagcgcgcccucucucggggacguggcucugguucgguacgucaacccugauacaggaagagugcuuuucgaggccaagcugcacaaaggcggguuucucaccguguccagcacaucuacgggccccgucgugguuccggccaauggauauuuccgcuuugacagcugggugaaccaauucuacucccuggcuccuaugggcaccgggaauggacggagacgcuuucaguga

SEQ ID NO: 27350 - RNA, 1623 nt, Artificial Sequence; identical to SEQ ID NO: 26482
  derived and/or modified sequence opt5 from VP1__Norovirus__AII73756

SEQ ID NO: 27351 - RNA, 1668 nt, Artificial Sequence
  derived and/or modified sequence opt5 from VP1__Norovirus__AII73759
augagaauggccagcuccgacgcucccgugucuggcaccgauggggccgcgggacuggucccugagagccagcaagaaguucucccgcuggagcccguggcuggcgugcagcuugccgccccugucgcugggcaguccaacaucauugaccccuggauccggaugaauuucgugcaggccccugcuggagaauuuacaguuucuccccgcaacgccccuggcgaggugcugauugaucucgaacuggggccggagcuuaaucccuaccugaaccaccucgcgagaauguauaauggauacgucggcggcauggagguggaaguugugcuggccgggaacgcuuucacggccggaaagauccuguuugcugccgucccucccagcuucccuacccauggcauuuccgcggcccaagcuacaaugcucccccacgugaucguggacguccggcagcuggagccgguucgccuuccucugcccgaugugagaaaugugauguuucauuucugccaggaaaacaaggagccucggaugcgcaucgucgccauucucuauacaccccugagagcuaauggggccggagacgauguguuuaccguuucuugucgggugcuuacccgccccagcccugacuucgauuuuaucuuccuggucccgcccuccguggagagcaagcucaaacaguuuacacugccuaaccugcaacccaaugaaaugaccaacucuagauucccuacgggcauuacccagcucuacacaucccccaauaccaaccugguugugcaguuucagaaugggcggugccuucuggacggaacacuccugggcaccacgccgguccgcgccgcugauaucuguagcuucagaggcgugacaucuaccgaggucgacgcgacagauuccccucggguggccgggagccaccgcauuaugguucaacuuagagaacccgacggagaggaguucucuccuaccggccccaacccugcucccguggggaccccggacuuucaggccgccaucuucggaacacugucccagcggaacacgggcggggcuggacaaaauagcaacagagcccauuuugcguauuucuacacccgcaauccuacauuugcucccggcauuggcaccgucguguucuccuuugauacaaccgacuuccagaaccggcagcccacgaaguuuucuccuagcgggguuuucgaugacgauuccagcgaaccguuuaaucaguucucucuccccuauuacaacggaucccugggcgccguggacgccgggaaacuggcuccucccgucgccccuaauuaccccggagagcaaauccucuauuuuagaggcagcgugccuuucaaagggggcuacggagaaggcgagaucgauucucugcuuccccaggaauggauuacacacuucuaugcugagcaggccccgacccagggggacgcggcccugcuccgcuacuauaacccugauaccggacgggugcuguuugaaugcaaacuucacagagagggcuucaucacaauuaauuacaccgggagcaacgcucuggccguucccgucaauggaguguuucgcuucgagggcugggugaacaaguuuuauacacucacgccuauggggaauggcaacggacggagaggccgccggagagaacuguga

SEQ ID NO: 27352 - RNA, 1668 nt, Artificial Sequence
  derived and/or modified sequence opt5 from VP1__Norovirus__AII73762
augaagauggccagcaaagacgcuucccccucuaccgauggcacagccaaccuggugccugagagccagcaagaaguccucgcgcugcagccgguugcuggggcccagaucgccgcucccguggccggacaguucaaugugauugacccuuggaucuaccaaaacuuuguccaggcucccgagggcgaguucacgguguccccuagaaauucuaccggggaaauucuuaugaaccuggaacucggaccccagcugaauccuuaucuugcccaccuggcgcggauguacaacgccuaugcuggcggguuugagguucaggugcuccuggccggaaaugcuuucacagccggcaagaucauugucugcgcggugccgcccaacuuuccucugcaaaauaucagcgccgcucaggccacccagcucccccauguuguggucgaugugcgccagcuggagccugugguccuuccccugccggacguuagagcuggcuucuaccacuauaaccaaguggaagagucccggaugcgccucguggccauccuguacacaccucuuagaaccaauucugccggggaugacgcuuuuacagucagcugucggauucugacccgccccgcgccugauuucuccuuuuucuuucucaucccucccacgauugaaagcaaaaccacacccuucacccugccgagacugcccaucucugagaugacaaacucccgguuuccucucgugauuaagggaaugguuguggaccccaaucugccucuucaggccaacuuccagaauggccgcaucacccuggauggggagcuccaaggaacgacacugcccaccagcacaucuauuggcagaaucuccgggacccauaugagcucuaccccgucccggaucauucagcacgaagacagcggagauuccacacagccucgcgucuucaaccccguguggauggaccuuacggagaacaauuggaccgaauuucagccuuucaacgaucaacccgcuccucugggcugccccgacuuuaaagccaagauccucggcacacugauuagacagccgaauaacgggucuuauuacuucgacgccuaccuggauacccggcagcauggaacauuugcuccuuauaccggccacgccgcgguucacagcgaccagcaagcugggcaucucgcccagggauacaagauccaguucucccccacgggcauugagagcgaucagaauacagaccugaaccaacuucccgauuaugggggagccaugaccgugucuaaaggccuggcuccugccgcugccccggacuuucccggcgaaaugauccucuacuucgucuccgauaugccugugcgcaaucccaacggggagagacgggacaccgagauccugugucuucugccucaggaaauggucacacacuuuuaugagcagcaggcgcccagccaaggagauguggcccucguuagauacauuaaugcugaaaccggccgcgugauguucgaggggaagcugcaucggaacggauuuuucacagucucugccacggcuagaacccugaucgugccugacggcuauuuucgcuucgauagcuggguuaaucgguucuacacacucucccccauggggaccggcaacggaagacgccgggccagaaugcuggaauga

SEQ ID NO: 27353 - RNA, 1638 nt, Artificial Sequence
  derived and/or modified sequence opt5 from VP1__Norovirus__AII73765
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucguugcgcagaaugugagcaucgcccaggcuacaauguuuccccacgucauugccgaugugagaguucucgaaccuaucgaagugccccuggaggacguccggaacgugcuguuccauaauaacgauaauaccccgacgaugcgccucguguguaugcuguacaccccucuuagagcuuccggcucuagcuccgggacagaccccuuugucauugccggacggguucugaccugcccuagccccgauuucucuuuucucuuccuggugcccccuaacguggagcagaagacaaaaccguuuuccguccccaaccuuccucugaauacccucagcaacucucgcgugcccucccugaucaagagcaugaugguuucuagagaccacggccaaauggugcaguuccagaaugggcgggucacgcuggauggacagcuccaaggcacaaccccuacauccgccagccagcuguguaagauucgcggcuccguguuucaugcuaacgggggaaauggcuauaaccuuaccgaacuggacgggucucccuaccacgcguucgagagcccggccccuaucggauuccccgaucucggcgaaugcgacuggcacauggaggcuuccccuaccacacaguuuaauacgggggacguuaucaaacaaauuaacgugaagcaggagagcgccuucgcuccccaucugggaaccauccaggccgauggccuuucugacgucuccgugaauacaaacaugauugccaaacugggcugggucagcccugugucugaugggcacaagggagacguugaucccugggugaucccgagauauggcagcacccucacagaagcggcucagcuggccccucccauuuaucccccuggguuuggagaggccaucgucuucuuuauguccgacuucccgaucgcucauggcaccaaugggcugucugugcccuguacgauuccucaagaauuuguuacacacuucgugaacgagcaggcccccacccggggcgaagcugcccuccugcacuaccuugauccugacacccaucgcaaucugggagaguuuaaacucuaccccgauggcuucaugacaugcgucccuaacagcuccgggaccggaccccagacacugccgaucaauggcguguuuguguucguuagcugggucucuagauuuuaccagcuuaagccuguggggacggcgggacccgcccggcgccugggcauuagacgguccuga

SEQ ID NO: 27354 - RNA, 1623 nt, Artificial Sequence; identical to SEQ ID NO: 27085
  derived and/or modified sequence opt5 from VP1__Norovirus__AII73768

SEQ ID NO: 27355 - RNA, 1608 nt, Artificial Sequence
  derived and/or modified sequence opt5 from VP1__Norovirus__AII73771
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggauccugguguuugcggccgugcccccucauuucccccuugaaaacauuuccccuggacagaucacaauguuuccccacgugaucauugauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaaaacgaagccuuuuacccugcccauccuuacaauuggagagcugaccaacucccgguucccuguccccaucgaugaacucuacacaagcccgaaugagucucuggugguucagccucagaacggccgcugugcccuugacggggaacugcagggaaccacgcaacuccugcccacagcuauuugcuccuuuagaggccggaucaaucagaaagugagcggcgagaaccacgucuggaauaugcaggucaccaacauuaaugggacaccuuucgaucccaccgaagacguuccugcuccccugggaaccccggauuucucuggcaagcucuuuggggugcugucccagcgcgaccaugacaacgccuguagaagccacgaugccgucaucgcgacaaauuccgccaaauucacgccuaaacuuggagcuauccaaauuggcaccugggagcaggacgaugugcacaucaaccagcccacaaaguuuacccccgucgggcuguucgagaaugaaggauuuaaccaauggacacucccuaauuauucuggcgcccugacccuuaacaugggccuggccccgcccguggcuccuacguuccccggggagcagauucucuuuuuccggagccauaucccucugaagggaggcguugccgaccccgugauugauugccugcucccucaggaauggauccagcaccuguaccaagaguccgcgcccagccagucugacgucgcucuuauccgcuuuacaaacccggauaccgggagagugcuguucgaagccaagcuccaucgguccggauacauuaccguugccaauacaggcagcagaccuaucgugguccccgcuaacggguauuuucgcuucgacucuugggugaaucaguuuuacagccuggccccuaugggcaccggaaacggccggagacgcgugcaguga

SEQ ID NO: 27356 - RNA, 1623 nt, Artificial Sequence
  derived and/or modified sequence opt5 from VP1__Norovirus__AII73774
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagcccccgcaauuccccuggagagauccuucuggaucucgaacugggcccggagcuuaaccccuaccuggcccaccucgcgcggauguauaaugggcaugccggaggcauggagguucagauugugcuggcuggcaacgccuucacggcugggaaaaucaucuuugccgcgauuccucccggauucccuuacgaaaaucugucucccagccagaucaccaugugcccgcacgucauuaucgacgugagacaacucgagccuguucugcuucccaugccugauauucggaacaacuuuuuccauuauaaucagggcaaugaccccaagcugcgccucaucgccaugcuguacacaccccuuagagcuaacaacuccggggaugacguguuuaccgucucuugucgggugcugacaaaaccuagcccggauuucgaauuuaccuuccucgugcccccuacagucgaguccaagaccaaacaguuuacgcugcccauucugaagaucagcgagaugaccaauucucgcuucccuguucccguggaaaugauguauacagccagaaacgagaaucaggugguccaaccgcagaacggacgggugacccucgacggcgaacugcuugggacaaccccucugcucgcuguuaauaucugcaaguuuaaaggagaggugauugccaagaacggcgauguccgcuccuacagaauggacauggaaaucacgaauacagauggcacccccauugacccuacagaggacacccccgggccuaucggaagccccgauuuccagggcauucuguucgggguggccucucagcggaacaaaaaugagcaaaacccggcuacccgcgcgcacgaagccaauaucaacacaggaggcgaccaguaugcuccuaaacuugcccagguuaaguuuuucuccgagagccaagauuuugaagugcaucagcccacggucuucacccccgugggggucgccggagacacaucucacccuuuuagacagugggugcugccgcgguacggcggccaccucaccaauaacacacaucuggcucccgccguugcgccucuguuccccggggagcagauccucuuuuuccgcucccaaauuccuagcuccggaggccacgaacugggguacauggauugucuugugccccaggaguggguccagcauuuuuaucaggaggcugccaccgcccaaucugaaguggcucugaucagauucauuaauccugacacgggacggguucucuuugaggccaagcugcacaagcagggcuucaucacaguggcucacaccggggauaaccccauugucaugccgccuaacggcuacuuuagauucgaagccugggugaaucaguucuauagccuugcgcccgugggaaccggcaacgggcgccggagaauccaguga

SEQ ID NO: 27357 - RNA, 1623 nt, Artificial Sequence
  derived and/or modified sequence opt5 from VP1__Norovirus__AII73777
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugcugccccaggaguggguucaauacuucuaucaggaggcugccccugcccagucugacgucgcucuccugcgguuugugaaucccgauaccgggagagugcuuuucgaauguaagcugcacaaauccggauacgucacaguggcccauaccggccaguaugaccucguuauuccgccuaacggguacuuucgcuucgauagcugggugaaccaauucuauacgcuggcucccaugggcaauggaaccggccggagacgcgccgucuga

SEQ ID NO: 27358 - RNA, 1611 nt, Artificial Sequence
  derived and/or modified sequence opt5 from VP1__Norovirus__AII73780
augaagauggccagcaacgacgcuacccccuccgaugacggcgccgcggggcuggugccugagaucaauucugaagucauggcucucgagccgguugccggagccagcauugcugcccccguggugggccagcaaaacaucauugauccuuggaucagaaauaacuucguccaggcucccgccggggaauuuacaguguccccucgcaauucucccggagagcugcuucuggaccucgaacugggcccugagcuuaacccguaccuggcgcaccucgcccggauguauaaugggcaugcuggaggcauggagguucagauugugcuggccggcaacgcuuucacggccgggaaaauccuguuugcggccauucccccuagcuuccccuacgaaaaucucuccccugcucagcugaccaugugcccccacgucaucguggauguuagacaacuugagccggugcugcucccuaugcccgacauccggaacgucuuuuaucauuacaaucagaacaauucuccuaagcugcgccuuguggccaugcuguauacaccccucagagcuaacaauagcggagaugacguguucaccgucuccugucggguucugacacgccccagcccugauuuucaguucaccuuucuggugccgcccacaguggaaucuaaaaccaagaacuucacgcucccuguccugagaguguccgagaugaccaacagccgguuucccguugugcuugaccagauguacacaucucgcaaugagaacaccauuguccaaccucagaauggcagaugcacaaccgauggggaacugcucggaacgacaauccugcaguccgugagcauuuguaacuucaaaggcaccaugcaggccaaacuuaaugaggaaccccgguaucaacugcagcucacaaaccuggacgggucuccgaucgauccuaccgacgacaugcccgccccucugggaacccccgauuuucaggcuguucucuacggcguggcgucccaacgcagcuccagagacaaugccacacgggcucacgaugcccagauugacacggccggcgauaccuucgcuccuaagaucgggcagguccgcuucaagucuagcuccaacgacuuugaucugcaugaccccacaaaguucaccccgaucggagugaaugucgaugaccagcacccuuuuagacaauggagccuucccaacuacggcgggcaccuggcccucaauaaccaucuggcgcccgcugugacaccucuuuucccgggagagcagauucuguuuuuccggucuuauauccccuccgccggcgggcacaccgauggagccauggacugccuccugccucaggaauggguugagcauuuuuaccaggaggcugcccccagccaaucugacauugcucuggugagauucaucaauccugauacgggccgcguccucuuugaagccaaacugcacaagcagggcuuccuuacaauugcggccagcggggaccaccccaucgugaugccuaccaacggauauuuucgguucgaggcuuggguuaaucccuuuuacacccuggccccggugggcacaggguccggaagacgccggauccaguga

SEQ ID NO: 27359 - RNA, 1632 nt, Artificial Sequence
  derived and/or modified sequence opt5 from VP1__Norovirus__AII73783
augaugauggccagcaaggacgcucccaccaacauggauggcacauccggggccggacagcuggugccugaggcgaauacggcugaaccgcuccccaucaaaccugucgccggcgccgcuaccgccguugcuacagccgggcaagugaacaugauugaccccuggaucaugaauaacuucgugcaggcgccucagggagaguuuaccauuucucccaauaacacaccuggcgauauccuguucgaccuucagcuggggccgcaccucaaucccuuucuggcccaucuuagcagaauguacaacggaugggucggcaauaugcaagugcggauuaugcuggcuggcaacgccuucuccgcugggaagaucaucguuugcuguauuccucccggauuuucuagccaguccaucucuauugcccaggcgaccauguucccucacgugaucgccgauguccgcgugcucgaacccauugacguuccgcuggaugacgugagaaauguccuguuucauaacaaugauaacccucagacaaugcggcuccugugcaugcuuuauacgccccugcgcagcggcgggaccuccagcggaaccgacccuuucgugaucgcuggcagagugcucacaugucccacccccgauuuuucuuuccuguuucuugucccuccggacauugagcaacggacaaaacccuucuccguuccuaauauccccaugaaccugaugagcaacucucgcguguccaugcucaucgaugggaugauggugagcaaugaccagaaccaggucccucaguuucaaaauggaagagugacccuggacggccagcugcagggcacgacaaccguuucugccgcuugcguggcccggaugcgcgggagaauuuucaacaauaacggaaauuacggcgucaaccucacagaacuggaugggaaucccuaucacgccuucgacuccccggcuccucuuggauuucccgauuucggcaacugugaccugcauaugaccuuugugaagaucaauccuaacgagcucagcuccggggaucccucuggaaaaguugugauucacagcuacgacgcgaccuucgccccucaccugggcacagucaaacuugagaaugaugacgaacuggcucgguuugugggcaaggaggucgugcucgaacugacguggguuuccaaccgcgagggggccacccugaaucucugggccgugcccaacuauggaagcucucugacacaggcuucccaacuugccccgccuaucuacccucccggcuucggggaggcgauugucuauuuuaccagcacauuccccaccgugucuaacccgaagguucccugcacgcugccucaggaauuugugagccauuucgucaaugagcaggcucccacaagaggagaugccgcccuccugcacuacguggacccugauacccaucggaaccuuggcgaauuuaagauguaccccgagggguauaugaccugugugccuaaugcuggcggaggcccccaaacacugccgaucaacgggguuuucgucuuuaucuccugggugucucgcuacuaucagcucaaaccugugggaaccgccggcgcugccagacggcuggggcugagacgcagcuga

SEQ ID NO: 27360 - RNA, 1608 nt, Artificial Sequence
  derived and/or modified sequence opt5 from VP1__Norovirus__AII73786
augaagauggccagcuccgacgcugcccccucuaacgauggcgcggcugggcuggugccugaggccaauaacgaaaccauggcccucgagccggucgcuggagccagcaucgcugcgccccugacaggccagaauaacauuaucgacccuuggauuagacuuaauuucguucaagcccccaacggggaauuuacgguguccccucgcaauucucccggagaggugcugcucaaccuggaacuuggcccugagcugaauccguaccucgcccaccugagccggauguauaacggguacgcuggaggcgucgaggugcagguucugcucgccggcaaugcuuucaccgccgggaaacugguguuugcggccgugcccccucauuucccccuugaaaacaucuccccuggacagauuacaauguuuccccacgugaucaucgauguuagaacccuggagccggugcuccugccucuucccgacguccggaauaacuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccauucuuacaaucggagagcugaccaacucccgguucccuguccccauugaugaacucuacacaagcccgaaugagucucuggugguucagccucagaacggccgcugugcccuugacggggaacugcagggaaccacgcaacuccugcccacagcuaucugcuccuuuagaggccggauuaaucagaaggugagcggcgagaaccacgucuggaauaugcaggucaccaacaucaaugggacaccuuucgaucccaccgaagacguuccugcuccccugggaaccccggauuucucuggcaaacucuuuggggugcugucccagcgcgaccaugacaacgccuguagaagccacgaugccgucauugcgacaaauuccgccaaguucacgccuaaacuuggagcuauccaaaucggcaccugggaggagaacgacgugcacauuaaucagcccacaaaguuuacccccgucgggcuguucgaagaugagggauuuaaccaguggacacucccuaauuauucuggcgcccugacccuuaacaugggccuggccccgcccguggcuccuacguuccccggggaacaaauccucuuuuuccggagccauauuccucugaagggaggcguugccgaccccgugaucgauugccugcucccucaggaguggauucagcaccuguaccaggaauccgcgcccagccaaucugacgucgcucuuauccgcuuuacaaacccggauaccgggagagugcuguucgaggccaaacuccaucgguccggauacaucaccguugccaauacaggcagcagaccuauugugguccccgcuaacggguauuuucgcuucgacucuugggugaaucaguuuuacagccuggccccuaugggcaccggaaacggccggagacgcgugcaguga

SEQ ID NO: 27361 - RNA, 1623 nt, Artificial Sequence
  derived and/or modified sequence opt5 from VP1__Norovirus__AIS40019
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucccgccccuggcggggaauuuaccgugucuccccggaaugcgccuggagagauucugugguccgccccgcuuggccccgaucugaacccuuaccucagccaccuggcucgcauguauaauggguacgccggaggcuucgaaguccaggugauccuugcuggcaacgccuuuacagcggggaaaguuauuuucgccgcugugcccccuaauuuucccacggagggacuguccccgucucaggucaccauguucccucauaucgugguggacgucagacagcucgagcccguucugaucccucugcccgaugugcggaacaauuuuuaucacuacaaccaaagcaaugaccccacaauuaagcucaucgccaugcuguauaccccucuucgcgcuaacaacgccggcgaugacguguucacagucuccugcagagugcugacccggccgagccccgauuuugacuucauuuuucucguuccucccacaguggaaucucgcaccaaaccuuucuccguccccgugcugacgguugaggaaaugaccaauagcagauuuccgaucccucuugagaagcuguucacagggcccucuuccgccuucgugguccagccucagaacggacgguguaccacagauggcgugcuccugggggcuacccagcugagccccgucaauauuugcacguuucgcggagacgugacacauaucaccggcucuagaaacuacacaaugaaucucgcgucccaaaacuggagcaauuaugauccuaccgaggaaauucccgccccgcugggcaccccugacuucguugggaaaauccagggagugcuuacacagacgacccggacagacggcuccacccgcgggcacaaggcuacagucuacaccggaucugccgauuuugcccccaagcugggcagagugcaguucgagacggacacagaucgggacuuugaagcuaaccaaaauaccaaauucacccccguuggggugauccaggauggaagcacaacccaucgcaacgagccucagcaauggguccucccguccuacagcggcagaaauacacccaacgugcaccuggccccugcgguggcucccacguuuccuggcgaacagcuucuguucuuucggucuaccaugcccggguguuccggauauccuaauauggaccucgauugccugcugccccaggaguggguucaguacuucuaucaagaggccgccccggcucagagcgacgucgcccuccugagauuugugaacccugauacaggccgcgugcuuuucgaauguaagcugcacaaaucuggguacgucaccguggcucauacaggacagcacgaccucguuauucccccuaauggcuauuuucgguucgauagcugggugaaccaguucuacacccuggcccccauggggaacggcacgggaagacgccgggcgcuuuga

SEQ ID NO: 27362 - RNA, 1623 nt, Artificial Sequence; identical to SEQ ID NO: 27133
  derived and/or modified sequence opt5 from VP1__Norovirus__AIV43147

SEQ ID NO: 27363 - RNA, 1623 nt, Artificial Sequence; identical to SEQ ID NO: 27137
  derived and/or modified sequence opt5 from VP1__Norovirus__AIV43148

SEQ ID NO: 27364 - RNA, 1623 nt, Artificial Sequence; identical to SEQ ID NO: 27137
  derived and/or modified sequence opt5 from VP1__Norovirus__AIV43149

SEQ ID NO: 27365 - RNA, 1623 nt, Artificial Sequence
  derived and/or modified sequence opt5 from VP1__Norovirus__AIV43150
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacugguccaauuaugauccuaccgaggaaauucccgcgccucugggcacacccgacuucguugggaaaauccagggagugcuuacgcagaccacacggaccgacggcucuacacgcgggcacaaggccaccgucuacacgggaagcgcugauuuugccccgaagcugggcagagugcaauucgagacagacaccgaucaugacuuugaagccaaccagaauaccaaauucacaccuguuggggugauccaggauggaggcaccacacaccggaacgagccccaacaguggguccuccccuccuacagcggccgcaauacgccuaacgugcaccuggcuccggccguggcgcccaccuuuccuggggaacagcuucuguucuuuagaucuacaaugcccggauguuccggcuauccuaauauggaccucgauugccugcugccccaggaguggguucaauacuucuaucaggaggcugccccugcccagagcgacgucgcucuccugcgguuugugaaccccgauaccgggagagugcuuuucgaauguaagcugcauaaaucuggauacgucacaguggcccacaccggccagcaugaccucguuauuccgccuaauggguauuuucgcuucgauagcugggugaaccaauucuacacgcuggcucccaugggcaacggaaccggccggagacgcgcccuuuga

SEQ ID NO: 27366 - RNA, 1623 nt, Artificial Sequence
  derived and/or modified sequence opt5 from VP1__Norovirus__AIV43151
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcgaugacguguucaccguguccugcagaguccugacccggccuagcccggauuuugacuucaucuuucucgugcccccuacaguugaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaggcaccacacaccggaacgagccccaacagugggugcucccuagcuacuccggccgcaauacgccgaacguccaccuggcucccgccguggcgccuaccuuucccggggaacagcuucuguucuuuagaagcacaaugccuggauguucuggcuaucccaauauggaccucgauugccugcugccucaggagugggugcaauacuucuaucaggaggcugcccccgcccaguccgacguugcucuccugcgguuugucaacccggauaccgggagagugcuuuucgaauguaagcugcauaaaagcggauacgugacagucgcccacaccggccagcaugaccucgugaucccucccaauggguauuuucgcuucgauucuuggguuaaccaauucuacacgcuggcuccuaugggcaacggaaccggccggagacgcgcccuuuga

SEQ ID NO: 27367 - RNA, 1623 nt, Artificial Sequence; identical to SEQ ID NO: 27133
  derived and/or modified sequence opt5 from VP1__Norovirus__AIV43152

SEQ ID NO: 27368 - RNA, 1623 nt, Artificial Sequence; identical to SEQ ID NO: 27133
  derived and/or modified sequence opt5 from VP1__Norovirus__AIV43153

SEQ ID NO: 27369 - RNA, 1623 nt, Artificial Sequence; identical to SEQ ID NO: 27133
  derived and/or modified sequence opt5 from VP1__Norovirus__AIV43154

SEQ ID NO: 27370 - RNA, 1623 nt, Artificial Sequence; identical to SEQ ID NO: 27085
  derived and/or modified sequence opt5 from VP1__Norovirus__AIV43155

SEQ ID NO: 27371 - RNA, 1623 nt, Artificial Sequence
  derived and/or modified sequence opt5 from VP1__Norovirus__AIV43156
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcuggcccggccuagcccggauuuugacuucauuuuucucguucccccuaccguggaaucucgcacaaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggagcaauuaugaucccaccgaggaaauuccugcuccccugggcaccccggacuucguugggaaaauccagggagugcuuacacagacgaccaagacagacggcuccacccgggggcacaaggccacagucuacaccggaucugccgauuuugccccuaaacugggccgcgugcaauucgagacggacacagaucaugacuuugaagcuaaccagaauaccaaguucacccccguuggggugauccaggauggaagcacaacccacagaaacgagccccaacaguggguccucccuuccuacagcggccggaauacaccgaacgugcaccuggcccccgcgguggcuccuacguuucccggcgaacagcuucuguucuuucgcucuaccaugccuggguguuccggauaucccaauauggaccucgauugccugcugccucaggaguggguucaauacuucuaucaggaggccgcccccgcucagagcgacgucgcccuccugagauuugugaacccggauacaggccgggugcuuuucgaauguaaacugcauaagucuggguacgucaccguggcucacacaggacagcaugaccucguuauuccucccaauggcuauuuuagauucgauagcugggugaaccaauucuacacccuggccccuauggggaacggcacgggacgccggagagcgcuuuga

SEQ ID NO: 27372 - RNA, 1623 nt, Artificial Sequence
  derived and/or modified sequence opt5 from VP1__Norovirus__AIV43159
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcuggcccggccuagcccggauuuugacuucauuuuucucguucccccuaccguggaaucucgcacaaaacccuucuccgucccugugcugaccguugaggaaaugacgaauagcagauuucccaucccgcuugagaagcuguucaccgggccuucuuccgcuuucgugguccagccccagaacggacgguguacaaccgauggcgugcuccuggggacaacccaacugagcccugucaauauuugcacguuucgcggagacgugacacauaucaccggcucuagaaacuacacaaugaaucucgcgucccagaacuggagcaauuaugaucccaccgaggaaauuccugcuccccugggcaccccggacuucguugggaaaauccagggagugcuuacacagacgacccggacagacggcuccacccgcgggcacaaggccacagucuacaccggaucugccgauuuugccccuaagcugggcagagugcaauucgagacggacacagaucaugacuuugaagcuaaccagaauaccaaauucacccccguuggggugauccaggauggaagcacaacccaccggaacgagccccaacaguggguccucccuuccuacagcggccgcaauacaccgaacgugcaccuggcccccgcgguggcuccuacguuucccggcgaacagcuucuguucuuuagaucuaccaugccuggguguuccggauaucccaauauggaccucgauugccugcugccucaggaguggguucaauacuucuaucaggaggccgcccccgcucagagcgacgucgcccuccugcgguuugugaacccggauacaggcagagugcuuuucgaauguaagcugcauaaaucuggguacgucaccguggcucacacaggacagcaugaccucguuauuccucccaauggcuauuuucgcuucgauagcugggugaaccaauucuacacccuggccccuauggggaacggcacgggacggagacgcgcgcuuuga

SEQ ID NO: 27373 - RNA, 1623 nt, Artificial Sequence
  derived and/or modified sequence opt5 from VP1__Norovirus__AIV43160
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugauccauauuaccggcucuagaaacuacacaaugaaucucgcuucccagaacuggagcaauuaugaucccaccgaggaaaucccugcgccccugggcaccccggacuucguugggaaaauccagggagugcuuacacagacgacccggacagacggcuccacccgcgggcacaaggccacagucuacaccggaucugcugauuuugccccuaagcugggcagagugcaauucgagacggacacagaucaugacuuugaagccaaccagaauaccaaauucacccccguuggggugauucaggauggaagcacaacccaccggaacgagccccaacaguggguccucccuuccuacagcggccgcaauacaccgaacgugcaccuggcucccgccguggcgccuacguuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacaggacagcaugaccucguuaucccucccaauggcuauuuucgcuucgauagcugggugaaccaauucuacacccuggcuccuauggggaacggcacgggacggagacgcgcccuuuga

SEQ ID NO: 27374 - RNA, 1623 nt, Artificial Sequence; identical to SEQ ID NO: 27373
  derived and/or modified sequence opt5 from VP1__Norovirus__AIV43161

SEQ ID NO: 27375 - RNA, 1623 nt, Artificial Sequence; identical to SEQ ID NO: 27133
  derived and/or modified sequence opt5 from VP1__Norovirus__AIV43162

SEQ ID NO: 27376 - RNA, 1623 nt, Artificial Sequence; identical to SEQ ID NO: 27133
  derived and/or modified sequence opt5 from VP1__Norovirus__AIV43163

SEQ ID NO: 27377 - RNA, 1623 nt, Artificial Sequence; identical to SEQ ID NO: 27373
  derived and/or modified sequence opt5 from VP1__Norovirus__AIV43164

SEQ ID NO: 27378 - RNA, 1623 nt, Artificial Sequence
  derived and/or modified sequence opt5 from VP1__Norovirus__AIV43165
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuuccuacagcggccgcaacacgccgaaugugcaccuggcucccgccguggcgccuaccuuucccggggaacagcuucuguucuuuagaucuacaaugccuggauguuccggcuaucccaacauggaccucgauugccugcugccucaggaguggguucaauacuucuaucaggaggcugcccccgcccagagcgacgucgcucuccugcgguuugugaauccggauaccgggagagugcuuuucgaauguaagcugcauaaaucuggauacgucacaguggcccacaccggccagcaugaccucguuauuccucccaacggguauuuucgcuucgauagcugggugaaucaauucuacacgcuggcuccuaugggcaacggaaccggccggagacgcgcccuuuga

SEQ ID NO: 27379 - RNA, 1623 nt, Artificial Sequence
  derived and/or modified sequence opt5 from VP1__Norovirus__AIV43166
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugaucccucccaauggcuauuuucgcuucgauagcuggguuaaccaauucuacacgcuggcuccuauggggaacggcaccggacggagacgcgcccuuuga

SEQ ID NO: 27380 - RNA, 1623 nt, Artificial Sequence
  derived and/or modified sequence opt5 from VP1__Norovirus__AIV43167
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaaaccaaccagaauacaaaauucacccccguuggggugauccaggauggaagcacaacgcaccggaacgagccccaacaguggguccucccuuccuacagcggccgcaauaccccgaacgugcaccuggcccccgcuguggccccuacauuucccggcgaacagcuucuguucuuuagaucuaccaugccuggguguuccggauaucccaauauggaccucgauugccugcugccucaggaguggguucaauacuucuaucaggaggcggcucccgcccagagcgacgucgcccuccugcgguuugugaacccggauacaggcagagugcuuuucgaauguaagcugcauaaaucuggguacgucaccguggcucacacgggacagcaugaccucguuauuccucccaauggcuauuuucgcuucgauagcugggugaaccaauucuacacccuggccccuauggggaacggcacaggacggagacgcgcucuuuga

SEQ ID NO: 27381 - RNA, 1623 nt, Artificial Sequence
  derived and/or modified sequence opt5 from VP1__Norovirus__AIV43171
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgagacagacaccaaucacgauuuugaagccaaccagaauaccaaauucacacccguuggggugauccaggacggaggcaccacacacagaaacgagccccaacaguggguccucccuucuuacagcggccggaauacgccgaacgugcaucuggcucccgccguggcgccuaccuuucccggggaacagcuucuguucuuucgcuccacaaugccuggauguagcggcuaucccaauauggaucucgacugccugcugccucaggaguggguucaauacuucuaucaggaggcugcccccgcccagucugaugucgcucuccugagauuugugaacccggacaccgggcgggugcuuuucgaauguaagcugcacaaauccggauacgucacaguggcccauaccggccagcacgaucucguuauuccucccaacggguauuuuagauucgacagcugggugaaucaauucuacacgcuggcuccuaugggcaacggaaccggccgccggagagcccuuuga

SEQ ID NO: 27382 - RNA, 1623 nt, Artificial Sequence
  derived and/or modified sequence opt5 from VP1__Norovirus__AIV43172
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauccaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugauuccucccaauggcuauuuucgcuucgauagcuggguuaaccaauucuacacgcuggcuccuauggggaacggcaccggacggagacgcgcccuuuga

SEQ ID NO: 27383 - RNA, 1623 nt, Artificial Sequence
  derived and/or modified sequence opt5 from VP1__Norovirus__AIV43173
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcauccaauucgagacagacaccaaucacgauuuugaagccaaccagaauaccaaauucacacccguggggguuauucaggacggaggcaccacacacagaaacgagccccaacagugggugcucccuucuuacagcggccggaauacgccgaacguccaucuggcucccgccguggcgccuaccuuucccggggaacagcuucuguucuuucgcuccacaaugccuggauguagcggcuaucccaauauggaucucgacugccugcugccucaggagugggugcaauacuucuaucaggaggcugcccccgcccagucugauguugcucuccugagauuugucaacccggacaccgggcgggugcuuuucgaauguaagcugcacaaauccggauacgugacagucgcccauaccggccagcacgaucucgugaucccucccaacggguauuuuagauucgacagcuggguuaaucaauucuacacgcuggcuccuaugggcaacggaaccggccgccggagagcccuuuga

SEQ ID NO: 27384 - RNA, 1623 nt, Artificial Sequence
  derived and/or modified sequence opt5 from VP1__Norovirus__AIV43174
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuuucuccuaagcugggcagagugcaauucgagacagacaccgaucaugacuuugaagccaaucagaacaccaaauucacacccguuggggugauccaggauggaggcaccacacaccggaaugagccccaacaguggguccucccuagcuacuccggccgcaacacgccgaaugugcaccuggcccccgcuguggccccuaccuuucccggggaacagcuucuguucuuuagaagcacaaugccuggauguucuggcuaucccaacauggaccucgauugccugcugccucaggaguggguucaauacuucuaucaggaggcggcucccgcccaguccgacgucgcccuccugcgguuugugaauccggauaccgggagagugcuuuucgaauguaagcugcauaaaagcggauacgucacaguggcucacaccggccagcaugaccucguuauuccucccaacggguauuuucgcuucgauucuugggugaaccaauucuacacgcuggccccuaugggcaauggaaccggccggagacgcgcucuuuga

SEQ ID NO: 27385 - RNA, 1623 nt, Artificial Sequence; identical to SEQ ID NO: 27384
  derived and/or modified sequence opt5 from VP1__Norovirus__AIV43175

SEQ ID NO: 27386 - RNA, 1623 nt, Artificial Sequence; identical to SEQ ID NO: 27133
  derived and/or modified sequence opt5 from VP1__Norovirus__AIV43176

SEQ ID NO: 27387 - RNA, 1623 nt, Artificial Sequence; identical to SEQ ID NO: 27328
  derived and/or modified sequence opt5 from VP1__Norovirus__AIV43177

SEQ ID NO: 27388 - RNA, 1623 nt, Artificial Sequence; identical to SEQ ID NO: 27382
  derived and/or modified sequence opt5 from VP1__Norovirus__AIV43178

SEQ ID NO: 27389 - RNA, 1623 nt, Artificial Sequence
  derived and/or modified sequence opt5 from VP1__Norovirus__AIV43179
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggacauuccugcgccccugggcacaccggacuucguugggaaaauccagggagugcuuacgcagaccacacggaccgauggcuccacacgcgggcacaaggccaccgucuacacgggaucugcugacuuugccccuaagcugggcagagugcaauucgaaacagauaccgaccaugauuuugaggccaaccagaauaccaaauucacacccguuggggugauccaggacggaggcaccacacaccggaacgaaccccaacaguggguccucccuagcuacuccggccgcaauacgccgaacgugcaccuggcucccgccguggcgccuaccuuucccggggagcagcuucuguucuuuagaagcacaaugccuggauguucuggcuaucccaauauggaucucgacugccugcugccucaggaauggguucaauacuucuaucaggaggcugcccccgcccaguccgaugucgcucuccugcgguuugugaacccggacaccgggagagugcuuuucgaguguaagcugcauaaaagcggauacgucacaguggcccacaccggccagcaugaucucguuauuccucccaauggguauuuucgcuucgacucuugggugaaccaauucuacacgcuggcuccuaugggcaacggaaccggccggagacgcgcccuuuga

SEQ ID NO: 27390 - RNA, 1623 nt, Artificial Sequence
  derived and/or modified sequence opt5 from VP1__Norovirus__AIY27747
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaguuauuuucgccgcugugccucccaacuuuccuacggagggacugagccccucccaggucaccauguucccgcauaucgugguggacgucagacaacucgagccuguucugaucccccugccugaugugcggaauaacuuuuaucacuacaaucagucuaacgaccccacaauuaagcucaucgccaugcuguauacaccccuucgcgcuaacaaugccggcgaugacguguucaccgucagcugcagagugcugacccggccuuccccggauuuugacuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagauggcgugcuccuggggaccacgcaacuguccccugucaacauuugcacauuucgcggagacgugacccauaucacaggcagcagaaauuacaccaugaaccucgcuucucagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaagcgcugauuuugccccuaagcugggcagagugcaauucgagacagacaccgaucaugacuuugaagccaaccagaauaccaaauucacacccguuggggugauccaggauggauccaccacacaccggaacgagccccaacaguggguccucccuucuuacagcggccgcaauacgccgaacgugcaccuggcucccgccguggcgccuaccuuucccggcgaacagcuucuguucuuuagauccacaaugccuggguguagcggauaucccaauauggaccucgauugccugcugccucaggaguggguucaauacuucuaucaggaggcugcccccgcccagucugacgucgcucuccugcgguuugugaacccggauaccggcagagugcuuuucgaauguaagcugcauaaauccggguacgucacaguggcccacaccggacagcaugaccucguuauuccucccaacggcuauuuucgcuucgauagcugggugaaucaauucuacacgcuggcuccuauggggaacggcaccggacggagacgcgcccuuuga

SEQ ID NO: 27391 - RNA, 1623 nt, Artificial Sequence; identical to SEQ ID NO: 27384
  derived and/or modified sequence opt5 from VP1__Norovirus__AJA71387

SEQ ID NO: 27392 - RNA, 1623 nt, Artificial Sequence
  derived and/or modified sequence opt5 from VP1__Norovirus__AJA71388
augaagauggccagcuccgacgcuaaccccucugauggcagcgccgcgaaucuggugccugaggucaacaaugaaguucucgcucuggagccgguggugggggccgccaucgcugcccccgucgcuggacagcaaaacgugauugacccuuggaucagaaauaacuucguucaggcccccggcggggaauuuaccguguccccucggaaugcgcccggagagauucuuuggucugccccucugggcccggaucucaaccccuaccugagccaccuugcucgcauguauaauggguacgccggaggcuucgaaguccaggugauccuggcuggcaacgccuuuacagcggggaaaguuauuuucgccgcugugccucccaauuuuccuacggagggacucucccccucucaggucaccauguucccgcauaucgugguggacgucagacaacuggagccuguucugaucccccucccugaugugcggaacaauuuuuaucacuacaaccagagcaaugaccccacaauuaagcugaucgccaugcuuuauacaccccugcgcgcuaacaacgccggcgaugacguguucaccgucuccugcagagugcucacccggccuagcccggauuuugacuucauuuuucugguucccccuacaguggaaucucgcaccaaacccuucuccgucccuauccuuacgguggaggaaaugaccaauagcagauuucccauuccgcuggagaagcuguucacagggccuucuuccgccuucguugugcagccccagaacggacgguguaccacagauggcguccugcuggggaccacgcaacucagcccugugaauaucugcacauuucgcggagacgucacccauauuacaggcucucacaacuacaccaugaaucuggcuucccagaacuggagcaauuaugaucccaccgaggaaaucccugcgccccuuggcacaccggacuucguggggaaaauccagggaguucugacgcagaccacaagaaccgacggcuccacacgggggcauaaggccaccguguacacgggaucugcugauuuugccccuaagcucggccgcguccaauucgagacagacaccgauagagacuuugaagccaaccagaauaccaaauucacacccguggggguuauucaggauggaggcaccacacaccggaacgagccccaacagugggugcugccuagcuacuccggccgcaauacgccgaacguccaccuugcucccgccguggcgccuaccuuucccggggaacagcuccucuucuuuagaagcacaaugccuggauguucuggcuaucccaauauggaccuggauugccugcucccucaggagugggugcaauacuucuaucaggaggcugcccccgcccaguccgacguugcucugcuucgguuugucaacccggauaccgggagagugcuguucgaauguaagcuccauaaaagcggauacgugacagucgcccacaccggccagcaugaccuggugaucccucccaauggguauuuucgcuucgauucuuggguuaaccaauucuacacgcuugcuccuaugggcaacggaaccggccggagacgcgcccuguga

SEQ ID NO: 27393 - RNA, 1623 nt, Artificial Sequence; identical to SEQ ID NO: 27382
  derived and/or modified sequence opt5 from VP1__Norovirus__AJA71389

SEQ ID NO: 27394 - RNA, 1623 nt, Artificial Sequence
  derived and/or modified sequence opt5 from VP1__Norovirus__AJA71390
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggccuccugcuggggaccacgcaacucagcccugugaauauuugcacauuucgcggagacgucacccauaucacaggcucuagaaacuacaccaugaaucuggcuucccagaacuggagcaauuaugaucccaccgaggaaauuccugcgccccuuggcacaccggacuucguggggaaaauccagggaguucugacgcagaccacacggaccgacggcuccacacgcgggcacaaggccaccguguacacgggaucugcugauuuugccccuaagcucggcagaguccaauucgagacagacaccgaucaugacuuugaagccaaccagaauaccaaauucacacccguggggguuauccaggauggaggcaccacacaccggaacgagccccaacagugggugcugccuagcuacuccggccgcaauacgccgaacguccaccuugcucccgccguggcgccuaccuuucccggggaacagcuccuguucuuuagaagcacaaugccuggauguucuggcuaucccaauauggaccuggauugccugcucccucaggagugggugcaauacuucuaucaggaggcugcccccgcccaguccgacguugcucugcuucgguuugucaacccggauaccgggagagugcuguucgaauguaagcuccauaaaagcggauacgugacagucgcccacaccggccagcaugaccuggugauuccucccaauggguauuuucgcuucgauucuuggguuaaccaauucuacacgcuugcuccuaugggcaacggaaccggccggagacgcgcccuguga

SEQ ID NO: 27395 - RNA, 1623 nt, Artificial Sequence; identical to SEQ ID NO: 27133
  derived and/or modified sequence opt5 from VP1__Norovirus__AJA71392

SEQ ID NO: 27396 - RNA, 1623 nt, Artificial Sequence; identical to SEQ ID NO: 27137
  derived and/or modified sequence opt5 from VP1__Norovirus__AJA71393

SEQ ID NO: 27397 - RNA, 1623 nt, Artificial Sequence
  derived and/or modified sequence opt5 from VP1__Norovirus__AJA71394
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacaucggaucugcugauuuugccccuaagcugggccgcgugcaauucgagacggacacaaaccacgauuuugaagccaaucagaacaccaaauucacccccguuggggugauucaggacggaggcacaacccacagaaaugagccccaacaguggguccucccuagcuacuccggccggaacacaccgaaugugcaucuggcucccgccguggcgccuacguuucccggggaacagcuucuguucuuucgcagcaccaugccuggauguucuggcuaucccaacauggaucucgacugccugcugccucaggaguggguucaauacuucuaucaggaggcugcccccgcccaguccgaugucgcucuccugagauuugugaauccggacacagggcgggugcuuuucgaauguaagcugcacaaaagcggauacgucaccguggcccauacaggccagcacgaucucguuaucccucccaacggguauuuuagauucgacucucgcgugaaccaauucuacacccuggcuccuaugggcaauggaacgggccggagacgcgcccuuuga

SEQ ID NO: 27398 - RNA, 1623 nt, Artificial Sequence; identical to SEQ ID NO: 27328
  derived and/or modified sequence opt5 from VP1__Norovirus__AJA71395

SEQ ID NO: 27399 - RNA, 1623 nt, Artificial Sequence
  derived and/or modified sequence opt5 from VP1__Norovirus__AJA71396
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauccaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgccuauaccggacagcacgaccucgugauuccucccaauggcuacuuucgcuucgauagcuggguuaaccaauucuauacgcuggcuccuauggggaacggcaccggacggagacgcgcccuuuga

SEQ ID NO: 27400 - RNA, 1623 nt, Artificial Sequence
  derived and/or modified sequence opt5 from VP1__Norovirus__AJA71399
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgccguggacgugagacaacucgagccuguccugaucccccugccugauguucggaacaauuuuuaucacuacaaccagagcaaugaccccacaauuaagcucaucgcuaugcuguauacaccccuucgcgccaacaacgccggcgaugacguguucaccguguccugcagaguccugacccggccuagcccggauuuugacuucauuuuucucgugcccccuacaguugaaucucgcaccaaacccuucuccgugccuguccugacgguggaggaaaugaccaauagcagauuucccaucccgcuugagaagcuguucacagggccuucuuccgcuuucguugugcagccccagaacggacgguguaccacagauggcguccuccuggggaccacgcaacugagcccugugaauauuugcacauuucgcggagacgucacccauaucacaggcucuagaaacuacaccaugaaucucgcgucccagaacuggagcaauuaugaucccaccgaggaaauuccugcuccccugggcacaccggacuucguggggaaaauccagggaguucuuacgcagaccacacggaccgacggcuccacacgcgggcacaaggccaccguguacacgggaucugccgauuuugccccuaagcugggcagaguccaauucgagacagacaccgaucaugacuuugaagcuaaccagaauaccaaauucacacccguggggguuauccaggauggaggcaccacacaccggaacgagccccaacagugggugcucccuagcuacuccggccgcaauacgccgaacguccaccuggcccccgcgguggcuccuaccuuucccggggaacagcuucuguucuuuagaagcacaaugccuggauguucuggcuaucccaauauggaccucgauugccugcugccucaggagugggugcaauacuucuaucaggaggccgcccccgcucaguccgacguugcccuccugcgguuugucaacccggauaccgggagagugcuuuucgaauguaagcugcauaaaagcggauacgugacagucgcucacaccggccagcaugaccucgugauuccucccaauggguauuuucgcuucgauucuuggguuaaccaauucuacacgcuggccccuaugggcaacggaaccggccggagacgcgcgcuuuga

SEQ ID NO: 27401 - RNA, 1623 nt, Artificial Sequence
  derived and/or modified sequence opt5 from VP1__Norovirus__AJA71400
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaaaccaaccagaauacaaaauucacccccguuggggugauccaggauggaggcacaacgcaucgcaacgagccccaacaguggguccucccuagcuacuccggcagaaauaccccgaacgugcaccuggcccccgcuguggccccuacauuucccggggaacagcuucuguucuuucggagcaccaugccuggauguucuggcuaucccaauauggaccucgauugccugcugccucaggaguggguucaauacuucuaucaggaggcggcucccgcccaguccgacgucgcccuccugagauuugugaacccggauacagggcgcgugcuuuucgaauguaagcugcacaaaagcggauacgucaccguggcucauacgggccagcacgaccucguuauuccucccaauggguauuuucgguucgauucuugggugaaccaauucuacacccuggccccuaugggcaacggaacaggcagacgccgggcucuuuga

SEQ ID NO: 27402 - RNA, 1623 nt, Artificial Sequence
  derived and/or modified sequence opt5 from VP1__Norovirus__AJA71401
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacaucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgggacagacaccgaucaugacuuugaggccaaccagaauaccaaauucacacccgugggaguuauucaggauggcagcaccacacaccggaacgaaccccaacagugggugcucccuuccuacagcggccgcaauacgccgaacguccaccuggcucccgccguggcgccuaccuuucccggggagcagcuucuguucuuuagaucuacaaugccuggauguuccggcuaucccaauauggaccucgauugccugcugccucaggaaugggugcaauacuucuaucaggaggcugcccccgcccagagcgacguugcucuccugcgguuugucaacccggauaccgggagagugcuuuucgaguguaagcugcauaaaucuggauacgugacagucgcccacaccggccagcaugaccucgugaucccucccaauggguauuuucgcuucgauagcuggguuaaccaauucuacacgcuggcuccuaugggcaacggaaccggccggagacgcgcccuuuga

SEQ ID NO: 27403 - RNA, 1623 nt, Artificial Sequence; identical to SEQ ID NO: 27137
  derived and/or modified sequence opt5 from VP1__Norovirus__AJA71402

SEQ ID NO: 27404 - RNA, 1623 nt, Artificial Sequence
  derived and/or modified sequence opt5 from VP1__Norovirus__AJA71403
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaaucgaaucucgcaccaaacccuucuccgugccuguccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggaauaacuaugaucccaccgaggaaaucccugcgccccugggcacaccggacuucguggggaaaauccagggaguucuuacgcagaccacacggaccgacggcagcacacgcgggcacaaggccaccguguacacgggauccgcugauuuuucuccuaagcugggcagaguccaauucgagacagacaccgaucaugacuuugaagccaaucagaacaccaaauucacacccguggggguuauucaggauggaggcaccacacaccggaaugagccccaacagugggugcucccuagcuacuccggccgcaacacgccgaauguccaccuggcccccgcuguggccccuaccuuucccggggaacagcuucuguucuuuagaagcacaaugccuggauguucuggcuaucccaacauggaccucgauugccugcugccucaggagugggugcaauacuucuaucaggaggcggcucccgcccaguccgacguugcccuccugcgguuugucaauccggauaccgggagagugcuuuucgaauguaagcugcauaaaagcggauacgugacagucgcucacaccggccagcaugaccucgugaucccucccaacggguauuuucgcuucgauucuuggguuaaccaauucuacacgcuggccccuaugggcaauggaaccggccggagacgcgcucuuuga

SEQ ID NO: 27405 - RNA, 1623 nt, Artificial Sequence; identical to SEQ ID NO: 27401
  derived and/or modified sequence opt5 from VP1__Norovirus__AJA71404

SEQ ID NO: 27406 - RNA, 1623 nt, Artificial Sequence
  derived and/or modified sequence opt5 from VP1__Norovirus__AJA71405
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagacaaaugaccccaccauuaagcucaucgccaugcuguauacaccccuucgcgcuaacaacgccggcgaugacguguucaccgucagcugcagagugcugacacggccuuccccggauuuugacuucauuuuucucguucccccuaccguggaaagccgcacgaaacccuucucugucccugugcugaccguugaggaaaugacaaauuccagauuucccaucccgcuugagaagcuguucaccgggccuagcucugccuucgugguccagccccagaacggacgguguacaaccgauggcgugcuccuggggacgacacaacuguccccugucaauauuugcaccuuucgcggagacgugacacauaucaccggcagcagaaacuacaccaugaaucucgcuucucagaacuggaauaacuaugaucccacagaggaaauuccugcgccccugggcaucccggacuucguugggaaaauccagggaaugcuuacgcagaccacacggaccgacggcuccacacgcgggcacaaggccaccguguacacgggaagcgucgauuuugcuccuaagcugggcagagugcaauucgagacagacaccgaucaugacuuugaagccaaucagaacaccaaauucacacccguuggggugauucaggauggauccaccacacaccggaaugagccccaacaguggguccucccuucuuacagcggccgcaacacgccgaaugugcaccuggcccccgcuguggccccuaccuuucccggcgaacagcuucuguucuuuagauccacaaugccuggguguagcggauaucccaacauggaccucgauugccugcugccucaggaguggguucaauacuucuaucaggaggcggcucccgcccagucugacgucgcccuccugcgguuugugaauccggauaccggcagagugcuuuucgaauguaagcugcauaaauccggguacgucacaguggcucacaccggacagcaugaccucguuaucccucccaacggcuauuuucgcuucgauagcugggugaaccaauucuacacgcuggccccuauggggaauggcaccggacggagacgcgcucuuuga

SEQ ID NO: 27407 - RNA, 1623 nt, Artificial Sequence
  derived and/or modified sequence opt5 from VP1__Norovirus__AJA71406
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgccgaaugugcaccuggcucccgccguggcgccuaccuuucccggcgaacagcuucuguucuuuagaagcacaaugccuggguguucuggauaucccaacauggaccucgauugccugcugccucaggaguggguucaauacuucuaucaggaggcugcccccgcccaguccgacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauucuugggugaaccaauucuacacgcuggcuccuauggggaauggcaccggacggagacgcgcccuuuga

SEQ ID NO: 27408 - RNA, 1623 nt, Artificial Sequence
  derived and/or modified sequence opt5 from VP1__Norovirus__AJA71407
augaagauggccagcuccgacgcuacccccucugauggcagcgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuacaguguccccucggaacgcgcccggagagauucuguggucugccccucuuggcccggaucugaaucccuaccucagccaccuggcucgcauguauaacggguacgccggaggcuucgaaguccaggugauccuugcuggcaaugccuuuacggcggggaaaguuauuuucgccgcugugccucccaacuuuccuaccgagggacugucccccucucaggucacaauguucccgcauaucgugguggacgucagacaacucgagccuguucugaucccccugccugaugugcggaauaacuuuuaucacuacaaucagagcaacgaccccaccauuaagcucaucgccaugcuguauacaccccuucgcgcuaauaacgccggcgaugacguguucaccgucuccugcagagugcugacacggccuagcccggauuuugacuucauuuuucucguucccccuaccguggaaucucgcacgaaacccuucuccgucccugugcugaccguugaggaaaugacaaacagcagauuucccaucccgcuugagaagcuguucaccgggccuucuuccgccuucgugguccagccccagaauggacgguguacaaccgauggcgugcuccuggggacgacacaacugagcccugucaacauuugcaccuuucgcggagacgugacacauaucaccggcucucacaauuacaccaugaaccucgcuucccagaauuggaacaauuaugaucccacagaggaaauuccugcgccccugggcacgccggacuucguugggaaaauccagggagugcuuacccagacaaccagaacagacggcagcacccgggggcauaaggccacggucuacacaggauccgcugauuuugccccuaagcugggccgcgugcaauucgagaccgacaccaaccacgauuuugaagccaaucagaacacaaaauucacccccguuggggugauccaggacggaucuacaacgcacagaaaugagccccaacaguggguccucccuagcuacuccggccggaacacccauaaugugcaccuggcuccggccguggcgcccacauuuccuggcgaacagcuucuguucuuucgcagcaccaugcccggguguucuggauauccuaacauggaucucgacugccugcugccccaggaguggguucaauacuucuaucaggaggcugccccugcccaguccgaugucgcucuccugagauuugugaaucccgacacaggccgggugcuuuucgaauguaagcugcauaaaagcggguacgucaccguggcccacacgggacagcacgaucucguuauuccgccuaacggcuauuuuagauucgacucuugggugaaccaauucuacacccuggcucccauggggaauggcacaggacgccggagagccgucuga

SEQ ID NO: 27409 - RNA, 1623 nt, Artificial Sequence; identical to SEQ ID NO: 27404
  derived and/or modified sequence opt5 from VP1__Norovirus__AJA71408

SEQ ID NO: 27410 - RNA, 1623 nt, Artificial Sequence; identical to SEQ ID NO: 27401
  derived and/or modified sequence opt5 from VP1__Norovirus__AJA71409

SEQ ID NO: 27411 - RNA, 1623 nt, Artificial Sequence
  derived and/or modified sequence opt5 from VP1__Norovirus__AJA71410
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccgauagagacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcgcccuuuga

SEQ ID NO: 27412 - RNA, 1623 nt, Artificial Sequence; identical to SEQ ID NO: 27328
  derived and/or modified sequence opt5 from VP1__Norovirus__AJA71411

SEQ ID NO: 27413 - RNA, 1623 nt, Artificial Sequence
  derived and/or modified sequence opt5 from VP1__Norovirus__AJA71412
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaacaggauacgucaccguggcccacacgggccagcaugaccucguuauuccucccaauggguauuuucgcuucgauagcugggugaaccaauucuacacccuggcuccuaugggcaacggaacaggccggagacgcgcccuuuga

SEQ ID NO: 27414 - RNA, 1623 nt, Artificial Sequence; identical to SEQ ID NO: 27133
  derived and/or modified sequence opt5 from VP1__Norovirus__AJA71413

SEQ ID NO: 27415 - RNA, 1623 nt, Artificial Sequence; identical to SEQ ID NO: 27085
  derived and/or modified sequence opt5 from VP1__Norovirus__AJA71416

SEQ ID NO: 27416 - RNA, 1623 nt, Artificial Sequence
  derived and/or modified sequence opt5 from VP1__Norovirus__AJA71417
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucaccucccagaacuggagcaauuaugaucccacagaggaaauuccugcuccccugggcacgccggacuucguugggaaaauccagggaaugcuuacccagacaacccggacagacggcuccacccgcgggcacaaggcgacgguguacacaggaucugccgauuuugcuccuaagcugggcagaguccaauucgagaccgacaccgaucaugacuuugaagccaaccagaauacaaaauucacccccguggggguuauccaggauggaagcacaacgcaccggaacgagccccaacagugggugcucccuuccuacagcggccgcaauaccccgaacguccaccuggcccccgcuguggccccuacauuucccggcgaacagcuucuguucuuuagaucuaccaugccuggguguuccggauaucccaauauggaccucgauugccugcugccucaggagugggugcaauacuucuaucaggaggcggcucccgcccagagcgacguugcccuccugcgguuugucaacccggauacaggcagagugcuuuucgaauguaagcugcauaaaucuggguacgugaccgucgcucacacgggacagcaugaccucgugauuccucccaauggcuauuuucgcuucgauagcuggguuaaccaauucuacacccuggccccuauggggaacggcacaggacggagacgcgcucuuuga

SEQ ID NO: 27417 - RNA, 1623 nt, Artificial Sequence
  derived and/or modified sequence opt5 from VP1__Norovirus__AJA71418
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuuccuacagcggccgcaacacgccgaaugugcaccuggcucccgccguggcgccuaccuuucccggggaacagcuucuguucuuuagaucuacaaugccuggauguuccggcuaucccaacauggaccucgauugccugcugccucaggaguggguucaauacuucuaucaggaggcugcccccgcccagagcgacgucgcucuccugcgguuugugaauccggauaccgggagagugcuuuucgaauguaagcugcauaaaucuggauacgucacaguggcccacaccggccagcaugaccucguuauuccucccaacggguauuuucgcuucgauagcugggugaaucaauucuacacgcuggcuccuaugggcaacggaaccggccggagacgcgcccuuuga

SEQ ID NO: 27418 - RNA, 1623 nt, Artificial Sequence; identical to SEQ ID NO: 27417
  derived and/or modified sequence opt5 from VP1__Norovirus__AJA71419

SEQ ID NO: 27419 - RNA, 1623 nt, Artificial Sequence; identical to SEQ ID NO: 27133
  derived and/or modified sequence opt5 from VP1__Norovirus__AJA71420

SEQ ID NO: 27420 - RNA, 1623 nt, Artificial Sequence; identical to SEQ ID NO: 27328
  derived and/or modified sequence opt5 from VP1__Norovirus__AJA71421

SEQ ID NO: 27421 - RNA, 1623 nt, Artificial Sequence; identical to SEQ ID NO: 27404
  derived and/or modified sequence opt5 from VP1__Norovirus__AJA71422

SEQ ID NO: 27422 - RNA, 1623 nt, Artificial Sequence
  derived and/or modified sequence opt5 from VP1__Norovirus__AJA71423
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacaucggaggcgcugauuuugccccuaagcuggggagaguccaauucgagacggacacagaucaugacuuugaagccaaccagaauaccaaauucacccccgugggaguuauucaggauggcucuacaacccaccggaacgagccccaacagugggugcucccuagcuacuccggccgcaauacaccgaacguccaccuggcucccgccguggcgccuacguuucccggggaacagcuucuguucuuuagaagcaccaugccuggauguucuggcuaucccaauauggaccucgauugccugcugccucaggagugggugcaauacuucuaucaggaggcugcccccgcccaguccgacguugcucuccugcgguuugucaacccggauacagggagagugcuuuucgaauguaagcugcauaaaagcggauacgugaccgucgcccacacaggccagcaugaccucgugaucccucccaauggguauuuucgcuucgauucuuggguuaaccaauucuacacccuggcuccuaugggcaacggaacgggccggagacgcgcccuuuga

SEQ ID NO: 27423 - RNA, 1623 nt, Artificial Sequence
  derived and/or modified sequence opt5 from VP1__Norovirus__AJA71424
augaagauggccagcuccgacgcuaaccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggaaugcuuacgcagaccacacggaccgacggcucuacacgcgggcacaaggccaccguguacacgggaagcgcugauuuugccccuaagcugggcagaguccaauucgagacagacaccgaucaugacuuugaagccaaucagaacaccaaauucacacccguggggguuauccaggauggauccaccacacaccggaaugagccccaacagugggugcucccuagcuacucuggccgcaacacgccgaauguccaccuggcucccgccguggcgccuaccuuucccggcgaacagcuucuguucuuuagauccacaaugccuggguguagcggauaucccaacauggaccucgauugccugcugccucaggagugggugcaauacuucuaucaggaggcugcccccgcccagucugacguugcucuccugcgguuugucaauccggauaccggcagagugcuuuucgaauguaagcugcauaaaagcggguacgugacagucgcccacaccggacagcaugaccucgugauuccucccaacggcuauuuucgcuucgauuccuggguuaaucaauucuacacgcuggcuccuauggggaacggcaccggacggaagagagcccuuuga

SEQ ID NO: 27424 - RNA, 1623 nt, Artificial Sequence
  derived and/or modified sequence opt5 from VP1__Norovirus__AJA71425
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccgugccgcuugagaagcuguucacagggccuucuuccgccuucgucgugcagccccagaacggacgguguaccacagauggcguccuccuggggaccacgcaacugagcccugugaauaucugcacauuucgcggagacguuacccauauuacaggcucucacaacuacaccaugaaucucgcuucccagaacuggagcaauuaugaucccaccgaggaaaucccugcgccccugggcacaccggacuucguggggaaaauucagggaguccuuacgcagaccacaagaaccgacggcuccacacgggggcauaaggccaccguguacacgggaucugcugauuuugccccuaagcugggccgcguucaauucgagacagacaccgauagagacuuugaagccaaccagaauaccaaauucacacccgugggggucauccaggauggaggcaccacacaccggaacgagccccaacagugggugcucccuagcuacuccggccgcaauacgccgaacgugcaccuggcucccgccguugcgccuaccuuucccggggaacagcuucuguucuuuagaagcacaaugccuggauguucuggcuaucccaauauggaccucgauugccugcugccucaggaguggguccaauacuucuaucaggaggcugcccccgcccaguccgacguggcucuccugcgguuugugaacccggauaccgggagaguccuuuucgaauguaagcugcauaaaagcggauacgugacaguugcccacaccggccagcaugaccucgugaucccucccaauggguauuuucgcuucgauucuugggucaaccaauucuacacgcuggcuccuaugggcaacggaaccggccggagacgcgcccuuuga

SEQ ID NO: 27425 - RNA, 1623 nt, Artificial Sequence
  derived and/or modified sequence opt5 from VP1__Norovirus__AJA71426
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcuccuaugaucccaccgaggaaauuccugcgccccugggcacaccggacuucguugggaaaauccagggaaugcuuacgcagaccacacggaccgacggcucuacacgcgggcacaaggccaccguguacacgggaagcgcugauuuugccccuaagcugggcagaguccaauucgagacagacaccgaucaugacuuugaagccaaucagaacaccaaauucacacccguggggguuauccaggauggauccaccacacaccggaaugagccccaacagugggugcucccuagcuacucuggccgcaacacgccgaauguccaccuggcucccgccguggcgccuaccuuucccggcgaacagcuucuguucuuuagauccacaaugccuggguguagcggauaucccaacauggaccucgauugccugcugccucaggagugggugcaauacuucuaucaggaggcugcccccgcccagucugacguugcucuccugcgguuugucaauccggauaccggcagagugcuuuucgaauguaagcugcauaaaagcggguacgugacagucgcccacaccggacagcaugaccucgugauuccucccaacggcuauuuucgcuucgauuccuggguuaaucaauucuacacgcuggcuccuauggggaacggcaccggacggagacgcgcccuuuga

SEQ ID NO: 27426 - RNA, 1623 nt, Artificial Sequence
  derived and/or modified sequence opt5 from VP1__Norovirus__AJA71427
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggggcaauuaugaucccaccgaggaaauuccugcgccccuggggacaccggacuucguuggaaaaauccagggcgugcuuacgcagaccacacggaccgacgggagcacacgcggacacaaggccaccgucuacacgggcuccgcugauuuugccccuaagcuggggagagugcaauucgagacagacaccgaucaugacuuugaagccaaccagaauaccaaauucacacccguuggagugauccaggauggcucuaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcgcccuuuga

SEQ ID NO: 27427 - RNA, 1623 nt, Artificial Sequence; identical to SEQ ID NO: 27411
  derived and/or modified sequence opt5 from VP1__Norovirus__AJA71428

SEQ ID NO: 27428 - RNA, 1623 nt, Artificial Sequence
  derived and/or modified sequence opt5 from VP1__Norovirus__AJA71429
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucauugugcagccccagaacggacgguguacaaccgauggcguucuccuggggacgacacaacugagcccugugaauaucugcaccuuucgcggagacgucacacauaucucuggcuccagaaacuacaccaugaaucucgccagccagaacuggaacuccuaugaucccaccgaggaaaccccugcuccccugggcacgccggacuucguggggaaaauucagggaguccuuacccagacaacccggacagacggcucuacccgcgggcacaaggcgacgguguacacaggaagcgccgauuuuuccccuaagcugggcagaguucaauucgcuaccgacaccgauaaugacuuugugacaaaucagaacaccaaauucacacccgucggggugauccaggauggaagcacgacaccccggaaugagccucaacaguggguucucccgucuuacuccggccgcaacacacauaaugugcaccuggcccccgccgucgcuccuaccuuucccggcgaacagcuucuguucuuuagaagcacaaugccuggguguucuggauaucccaacauggaccucgauugccugcugccucaggagugggugcaauacuucuaucaggaagccgcgcccgcucagagcgacguggcccuccugcgguuuguuaauccggauaccggcagaguccuuuucgaguguaagcugcacaaaacgggguacgugaccguggcccauacaggacagcacgaccucgucauuccucccaacggcuauuuucgcuucgauuccugggugaaccaauucuacacccuggcuccuauggggaauggcacaggacggagacgcguucuuuga

SEQ ID NO: 27429 - RNA, 1623 nt, Artificial Sequence
  derived and/or modified sequence opt5 from VP1__Norovirus__AJA71430
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugacgccaaucagaacaccaaauucacacccguuggggugauccaggauggaggcaccacacacagaaaugaaccccaacaguggguccucccuagcuacuccggccggaacacgccgaaugugcaucuggcucccgccguggcgccuaccuuucccggggagcagcuucuguucuuucgcagcacaaugccuggauguucuggcuaucccaacauggaccucgauugccugcugccucaggaauggguucaauacuucuaucaggaggcugcccccgcccaguccgacgucgcucuccugagauuugugaauccggauaccgggcgggugcuuuucgaguguaagcugcacaaaagcggauacgucacaguggcccauaccggccagcacgaccucguuauuccucccaacggguauuuuagauucgauucuugggugaaccaauucuacacgcuggcuccuaugggcaauggaaccggccgccggagagcccuuuga

SEQ ID NO: 27430 - RNA, 1623 nt, Artificial Sequence
  derived and/or modified sequence opt5 from VP1__Norovirus__AJA71456
augaagauggccagcuccgacgcuaaccccucugauggcagcgccgcgaaucuggugccugaggucaacaaugaaguuauggcucucgagccgguggugggggccaccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaguuauuuucgcggccgugccucccaauuuuccuaccgagggacugucccccucucaggucacaauguucccgcauaucgugguggacgucagacaacucgagccuguucugaucccccugccugaugugcggaacaauuuuuaucacuacaaccagagcaaugaccccaccauuaagcucaucgcuaugcuguauacaccccuucgcgccaacaacgcuggcgaugacguguucaccgucuccugcagagugcugacacggccuagcccggauuuugacuucauuuuucucguucccccuaccguggaaucucgcacgaaacccuucuccgucccuauccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuaccggcucuagaaacuacaccaugaaucucgccucccagaacuggagcaauuaugaucccacagaggaaaucccugcuccccugggcaucccggacuucguggggaaaauucagggaaugcuuacgcagaccacacggaccgacggcuccacacgcgggcacaaggcgaccguuuacacgggaucugccgauuuugcuccuaagcugggcagagugcaauucgagacagacaccgaucaugacuuugaagccaaccagaauaccaaauucacacccgucggggugauccaggauggaagcaccacacaccggaacgagccccaacaguggguucucccuuccuacagcggccgcaauacgccgaacgugcaccuggcccccgcugucgccccuaccuuucccggcgaacagcuucuguucuuuagaucuacaaugccuggguguuccggauaucccaauauggaccucgauugccugcugccucaggagugggugcaauacuucuaucaggaggcggcucccgcccagagcgacguggcccuccugcgguuuguuaacccggauaccggcagaguccuuuucgaauguaagcugcauaaaucuggguacgugacaguggcucacaccggacagcaugaccucgucauuccucccaauggcuauuuucgcuucgauagcugggugaaccaauucuacacgcuggccccuauggggaacggcaccggacggagacgcgcucuuuga

SEQ ID NO: 27431 - RNA, 1623 nt, Artificial Sequence
  derived and/or modified sequence opt5 from VP1__Norovirus__AJA71457
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgccgaacgugcaccuggcucccgccguggcgccuaccuuucccggcgaacagcuucuguucuuuagaucuacaaugccuggguguuccggauaucccagcauggaccucgauugccugcugccucaggaguggguucaauacuucuaucaggaggcugcccccgcccagucugacgucgcucuccugcgguuugugaauccggauaccggcagagugcuuuucgaauguaagcugcauaaaagcggguacgucacaguggcccacaccggacagcaugaccucguuauuccucccaacggcuauuuucgcuucgauuccugggugaaucaauucuacacgcuggcuccuauggggaacggcaccggacggagacgcgcccuuuga

SEQ ID NO: 27432 - RNA, 1623 nt, Artificial Sequence
  derived and/or modified sequence opt5 from VP1__Norovirus__AJA71458
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccgcggaggaaauuccugcuccccugggcaccccggacuucguugggaaaauccagggagugcuuacacagacgaccagaacagacggcuccacccgggggcauaaggccacagucuacaccggaucugccgauuuugccccuaagcugggccgcgugcaauucgagacggacacagauagagacuuugaagcuaaccagaauaccaaauucacccccguuggggugauccaggauggaggcacaacccaccggaacgagccccaacaguggguccucccuagcuacuccggccgcaauacaccgaacgugcaccuggcccccgcgguggcuccuacguuucccggggaacagcuucuguucuuuagaagcaccaugccuggauguucuggcuaucccaauauggaccucgauugccugcugccucaggaguggguucaauacuucuaucaggaggccgcccccgcucaguccgacgucgcccuccugcgguuugugaacccggauacagggagagugcuuuucgaauguaagcugcauaaaagcggauacgucaccguggcucacacaggccagcaugaccucguuauuccucccaauggguauuuucgcuucgauucuugggugaaccaauucuacacccuggccccuaugggcaacggaacgggccggagacgcgcgcuuuga

SEQ ID NO: 27433 - RNA, 1623 nt, Artificial Sequence
  derived and/or modified sequence opt5 from VP1__Norovirus__AJA71459
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucuguggauuuugcuccuaagcugggcagaguucaauucgagacagacaccgaucaugacuuugaagccaaccagaauaccaaauucacacccgugggggucauccaggauggaagcaccacacaccggaacgagccccaacagugggugcucccuuccuacagcggccgcaauacgccgaacgugcaccuggcccccgcuguugccccuaccuuucccggcgaacagcuucuguucuuuagaucuacaaugccuggguguuccggauaucccaauauggaccucgauugccugcugccucaggaguggguccaauacuucuaucaggaggcggcucccgcccagagcgacguggcccuccugcgguuugugaacccggauaccggcagaguccuuuucgaauguaagcugcauaaaucuggguacgugacaguugcucacaccggacagcaugaccucgugauuccucccaauggcuauuuucgcuucgauagcugggucaaccaauucuacacgcuggccccuauggggaacggcaccggacggagacgcgcucuuuga

SEQ ID NO: 27434 - RNA, 1623 nt, Artificial Sequence; identical to SEQ ID NO: 27404
  derived and/or modified sequence opt5 from VP1__Norovirus__AJA71460

SEQ ID NO: 27435 - RNA, 1623 nt, Artificial Sequence; identical to SEQ ID NO: 27133
  derived and/or modified sequence opt5 from VP1__Norovirus__AJA71461

SEQ ID NO: 27436 - RNA, 1623 nt, Artificial Sequence; identical to SEQ ID NO: 27407
  derived and/or modified sequence opt5 from VP1__Norovirus__AJA71462

SEQ ID NO: 27437 - RNA, 1623 nt, Artificial Sequence; identical to SEQ ID NO: 27417
  derived and/or modified sequence opt5 from VP1__Norovirus__AJA71463

SEQ ID NO: 27438 - RNA, 1623 nt, Artificial Sequence; identical to SEQ ID NO: 27411
  derived and/or modified sequence opt5 from VP1__Norovirus__AJA71464

SEQ ID NO: 27439 - RNA, 1623 nt, Artificial Sequence; identical to SEQ ID NO: 27411
  derived and/or modified sequence opt5 from VP1__Norovirus__AJA71465

SEQ ID NO: 27440 - RNA, 1623 nt, Artificial Sequence
  derived and/or modified sequence opt5 from VP1__Norovirus__AJA71466
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaaccugguucaggcccccggcggggaguucaccguguccccucggaaugcgcccggagaaauucuuuggucugccccucugggcccggaacucaaccccuaccugagccaccuugcucgcauguauaauggguacgccggaggcuuugagguccaggugauccuggcuggcaacgccuucacagcggggaaaguuauuuuugccgcugugccucccaauuucccuacggagggacucucccccucucaggucaccauguuuccgcauaucgugguggaugucagacaacuggaaccuguucugaucccccucccugacgugcggaacaauuucuaucacuacaaccagagcaaugaucccacaauuaagcugaucgccaugcuuuauacaccccugcgcgcuaacaacgccggcgacgauguguuuaccgucuccugcagagugcucacccggccuagcccggacuucgauuuuauuuuccugguucccccuacaguggagucucgcaccaaacccuuuuccgucccugugcuuacgguugaagagaugaccaauagcagauuccccaucccgcuggagaagcucuuuacagggccuucuuccgccuucgugguccagccccagaacggacgguguaccacagacggcgugcugcuggggaccacgcaacucagcccugucaauauuugcacauuccgcggagaugugacccauaucacaggcucuagaaacuacaccaugaaucuggcuucccagaacuggagcaauuaugaccccaccgaagagauuccugcgccccuuggcacaccggauuuuguugggaaaauccagggagugcugacgcagaccacacggaccgacggcuccacacgcgggcacaaggccaccgucuacacgggaucugcugacuucgccccuaagcucggcagagugcaauuugaaacagauaccgaccgggauuucgaggccaaccagaauaccaaauuuacacccguuggggugauccaggacggaagcaccacacaucgcaacgaaccccaacaguggguccugccuuccuacagcggcagaaauacgccgaacgugcaccuugcucccgccguggcgccuaccuuccccggcgagcagcugcucuuuuuccggucuacaaugccuggguguuccggauaucccaauauggaucuggacugccugcucccucaggaguggguucaauacuuuuaucaggaagcugcccccgcccagagcgaugucgcucugcuuagauucgugaacccggacaccggccgcgugcuguuugaguguaagcuccacaaaucuggguacgucacaguggcccauaccggacagcacgaucugguuauuccucccaauggcuauuuccgguuugacagcugggugaaccaauucuacacgcuugcuccuauggggaacggcaccggaagacgccgggcccuguga

SEQ ID NO: 27441 - RNA, 1623 nt, Artificial Sequence
  derived and/or modified sequence opt5 from VP1__Norovirus__AJA71467
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacacccgguucacacccguuggggugauccaggauggaggcaccacacaccgcaaugagccccaacaguggguccucccuucuuacagcggcagaaacacgccgaaugugcaccuggcucccgccguggcgccuaccuuucccggggaacagcuucuguucuuucgguccacaaugccuggauguagcggcuaucccaacauggaccucgauugccugcugccucaggaguggguucaacauuucuaccaggaggcugcccccgcccagucugacgucgcucuccugagauuugugaauccggauaccgggcgcgugcuuuucgaauguaaacugcacaaguccggauaugucacaguggcccauaccggccagcacgaccucguuauuccucccaacggguacuuucgguucgauagcugggugaaccaauucuauacgcuggcuccuaugggcaauggaaccggcagacgccgggcccuuuga

SEQ ID NO: 27442 - RNA, 1623 nt, Artificial Sequence
  derived and/or modified sequence opt5 from VP1__Norovirus__AJA71470
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccuauccugacgguggaggaaaugaccaauagcagauuucccauuccgcuugagaagcuguucacagggccuucuuccgccuucguugugcagccccagaacggacgguguaccacagauggcguccuccuggggaccacgcaacugagcccugugaauaucugcacauuucgcggagacgucacccauauuacaggcucuagaaacuacaccaugaaucucgcuucccagaacuggagcaauuaugaucccaccgaggaaaucccugcgccccugggcaucccggacuucguggggaaaauucagggaaugcuuacacagacgacccggacagacggcuccacccgcgggcacaaggccacaguuuacaccggaucugcugauuuugccccuaagcugggcagagugcaauucgagacggacacagaucaugacuuugaagccaaccagaauaccaaauucacccccgucggggugauccaggauggaagcacaacccaccggaacgagccccaacaguggguucucccuuccuacagcggccgcaauacaccgaacgugcaccuggcucccgccgucgcgccuacguuucccggcgaacagcuucuguucuuuagaucuaccaugccuggguguuccggauaucccaauauggaccucgauugccugcugccucaggagugggugcaauacuucuaucaggaggcugcccccgcccagagcgacguggcucuccugcgguuuguuaacccggauacaggcagaguccuuuucgaauguaagcugcauaaaucuggguacgugaccguggcccacacaggacagcaugaccucgucauuccucccaauggcuauuuucgcuucgauagcugggugaaccaauucuacacccuggcuccuauggggaacggcacgggacggagacgcgcccuuuga

SEQ ID NO: 27443 - RNA, 1623 nt, Artificial Sequence
  derived and/or modified sequence opt5 from VP1__Norovirus__AJA71471
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaacugaaccccuaccucagccaccuggcucgcauguauaauggguacgccggaggcuucgagguccaggugauccuugcuggcaacgccuuuacagcggggaaaguuauuuucgccgcugugccucccaauuuuccuacggagggacugucccccucucaggucaccauguucccgcauaucgugguggaugucagacaacucgaaccuguucugaucccccugccugacgugcggaacaauuuuuaucacuacaaccagagcaaugaucccacaauuaagcucaucgccaugcuguauacaccccuucgcgcuaacaacgccggcgacgauguguucaccgucuccugcagagugcugacccggccuagcccggacuuugauuucauuuuucucguucccccuacaguggagucucgcaccaaacccuucuccgucccugugcugacgguugaagagaugaccaauagcagauuucccaucccgcuugagaagcuguucacagggccuucuuccgccuucgugguccagccccagaacggacgguguaccacagacggcgugcuccuggggaccacgcaacugagcccugucaauauuugcacauuucgcggagaugugacccauaucacaggcucuagaaacuacaccaugaaucucgcuucccagaacuggagcaauuaugaccccaccgaagagauuccugcgccccugggcacaccggauuucguugggaaaauccagggagugcuuacgcagaccacacggaccgacggcuccacacgcgggcacaaggccaccgucuacacgggaucugcugacuuugccccuaagcugggcagagugcaauucgaaacagauaccgaccgggauuuugaggccaaccagaauaccaaauucacacccguuggggugauccaggacggaagcaccacacaucgcaacgaaccccaacaguggguccucccuuccuacagcggcagaaauacgccgaacgugcaccuggcucccgccguggcgccuaccuuucccggcgagcagcuucuguucuuucggucuacaaugccuggguguuccggauaucccaauagagaucucgacugccugcugccucaggaguggguucaauacuucuaucaggaagcugcccccgcccagagcgaugucgcucuccugcgcuuugugaacccggacaccggccgggugcuuuucgaguguaagcugcacaaaucuggguacgucacaguggcccauaccggacagcacgaucucguuauuccucccaauggcuauuuuagauucgacagcugggugaaccaauucuacacgcuggcuccuauggggaacggcaccggacgccggagagcccuuuga

SEQ ID NO: 27444 - RNA, 1623 nt, Artificial Sequence
  derived and/or modified sequence opt5 from VP1__Norovirus__AJA71472
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaacugaaccccuaccucagccaccuggcucgcauguauaauggguacgccggaggcuucgagguccaggugauccuugcuggcaacgccuuuacagcggggaaaguuauuuucgccgcugugccucccaauuuuccuacggagggacugucccccucucaggucaccauguucccgcauaucgugguggaugucagacaacucgaaccuguucugaucccccugccugacgugcggaacaauuuuuaucacuacaaccagagcaaugaucccacaauuaagcucaucgccaugcuguauacaccccuucgcgcuaacaacgccggcgacgauguguucaccgucuccugcagagugcugacccggccuagcccggacuuugauuucauuuuucucguucccccuacaguggagucucgcaccaaacccuucuccgucccugugcugacgguugaagagaugaccaauagcagauuucccaucccgcuugagaagcuguucacagggccuucuuccgccuucgugguccagccccagaacggacgguguaccacagacggcgugcuccuggggaccacgcaacugagcccugucaauauuugcacauuucgcggagaugugacccauaucacaggcucuagaaacuacaccaugaaucucgcuucccagaacuggagcaauuaugaccccaccgaagagauuccugcgccccugggcacaccggauuucguugggaaaauccagggagugcuuacgcagaccacacggaccgacggcuccacacgcgggcacaaggccaccgucuacacgggaucugcugacuuugccccuaagcugggcagagugcaauucgaaacagauaccgaccgggauuuugaggccaaccagaauaccaaauucacacccguuggggugauccaggacggaagcaccacacaucgcaacgaaccccaacaguggguccucccuuccuacagcggcagaaauacgccgaacgugcaccuggcucccgccguggcgccuaccuuucccggcgagcagcuucuguucuuucggucuacaaugccuggguguuccggauaucccaauauggaucucgacugccugcugccucaggaguggguucaauacuucuaucaggaagcugcccccgcccagagcgaugucgcucuccugagauuugugaacccggacaccggccgcgugcuuuucgaguguaagcugcacaaaucuggguacgucacaguggcccauaccggacagcacgaucucguuauuccucccaauggcuauuuucgguucgacagcugggugaaccaauucuacacgcuggcuccuauggggaacggcaccggaagacgccgggcccuuuga

SEQ ID NO: 27445 - RNA, 1623 nt, Artificial Sequence
  derived and/or modified sequence opt5 from VP1__Norovirus__AJA71473
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucgggacuuugaagccaaucagaacaccaaauucacacccguuggggugauccaggauggaggcaccacacaucgcaaugagccccaacaguggguccucccuuccuacagcggcagaaacacgccgaaugugcaccuggcucccgccguggcgccuaccuuucccggggaacagcuucuguucuuucggucuacaaugccuggauguuccggcuaucccaacauggaccucgauugccugcugccucaggaguggguucaauacuucuaucaggaggcugcccccgcccagagcgacgucgcucuccugagauuugugaauccggauaccgggcgcgugcuuuucgaauguaagcugcacaaaucuggauacgucacaguggcccauaccggccagcacgaccucguuauuccucccaacggguauuuucgguucgauagcugggugaaucaauucuacacgcuggcuccuaugggcaacggaaccggcagacgccgggcccuuuga

SEQ ID NO: 27446 - RNA, 1623 nt, Artificial Sequence
  derived and/or modified sequence opt5 from VP1__Norovirus__AJA71474
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaggcaccacacaucgcaacgagccccaacaguggguccucccuagcuacuccggcagaaauacgccgaacgugcaccuggcucccgccguggcgccuaccuuucccggggaacagcuucuguucuuucggagcacaaugccuggauguucuggcuaucccaauaccgaccucgauugccugcugccucaggaguggguucaauacuucuaucaggaggcugcccccgcccaguccgacgucgcucuccugagauuugugaacccggauacagggcgcgugcuuuucgaauguaagcugcacaaaagcggauacgucaccguggcccauacgggccagcacgaccucguuauuccucccaauggguauuuucgguucgauucuugggugaaccaauucuacacccuggcuccuaugggcaacggaacaggcagacgccgggcccuuuga

SEQ ID NO: 27447 - RNA, 1623 nt, Artificial Sequence; identical to SEQ ID NO: 27328
  derived and/or modified sequence opt5 from VP1__Norovirus__AJA71475

SEQ ID NO: 27448 - RNA, 1623 nt, Artificial Sequence; identical to SEQ ID NO: 27407
  derived and/or modified sequence opt5 from VP1__Norovirus__AJA71476

SEQ ID NO: 27449 - RNA, 1623 nt, Artificial Sequence
  derived and/or modified sequence opt5 from VP1__Norovirus__AJF21974
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaagucagagugauccuugcuggcaacgccuuuacagcggggaaaguuauuuucgccgcugugccucccaauuuuccuacggagggacugucccccucucaggucaccauguucccgcauaucgugguggacguccggcagcucgagccuguucugaucccccugccugaugugcgcaacaauuuuuaucacuacaaccaaagcaaugaccccacaauuaagcucaucgccaugcuguauacaccccuuagagcuaacaacgccggcgaugacguguucaccgucuccugccgggugcugacccgcccuagcccggauuuugacuucauuuuucucguucccccuacaguggaaucuagaaccaaacccuucuccgucccuauccugacgguggaggaaaugaccaauagccgguuucccauuccgcuugagaagcuguucacagggccuucuuccgccuucguugugcagccccagaacggacgcuguaccacagauggcguccuccuggggaccacgcagcugagcccugugaauaucugcacauuuagaggagacgucacccauauuacaggcucucggaacuacaccaugaaucucgcuucccaaaacuggagcaauuaugaucccaccgaggaaaucccugcgccccugggcaucccggacuucguggggaaaauucagggaaugcuuacacagacgacccgcacagacggcuccaccagagggcacaaggccacaguuuacaccggaucugcugauuuugccccuaagcugggccgggugcaguucgagacggacacagaucaugacuuugaagccaaccaaaauaccaaauucacccccgucggggugauccaggauggaagcacaacccaccgcaacgagccccagcaauggguucucccuuccuacagcggcagaaauacaccgaacgugcaccuggcucccgccgucgcgccuacguuucccggcgaacagcuucuguucuuucggucuaccaugccuggguguuccggauaucccaauauggaccucgauugccugcugccucaggagugggugcaguacuucuaucaagaggcugcccccgcccagagcgacguggcucuccugagauuuguuaacccggauacaggccgcguccuuuucgaauguaagcugcauaaaucuggguacgugaccguggcccacacaggacagcaugaccucgucauuccucccaauggcuauuuucgguucgauagcugggugaaccaguucuacacccuggcuccuauggggaacggcacgggaagacgccgggcccuuuga

SEQ ID NO: 27450 - RNA, 1623 nt, Artificial Sequence
  derived and/or modified sequence opt5 from VP1__Norovirus__AJF21975
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuaacuuugccccuaagcugggcagagugcaauucgagacagauaccgaccaugauuuugaagccaaucagaacaccaaauucacacccguuggggugauccaggacggaggcaccacacaccggaaugagccccaacaguggguccucccuagcuacuccggccgcaacacgccgaaugugcaccuggcucccgccguggcgccuaccuuucccggggaacagcuucuguucuuuagaagcacaaugccuggauguucuggcuaucccaacauggaucucgacugccugcugccucaggaguggguucaauacuucuaucaggaggcugcccccgcccaguccgaugucgcucuccugcgguuugugaauccggacaccgggagagugcuuuucgaauguaagcugcauaaaagcggauacgucacaguggcccacaccggccagcaugaucucguuauuccucccaacggguauuuucgcuucgacucuugggugaaccaauucuacacgcuggcuccuaugggcaauggaaccggccggagacgcgcccuuuga

SEQ ID NO: 27451 - RNA, 1623 nt, Artificial Sequence; identical to SEQ ID NO: 27382
  derived and/or modified sequence opt5 from VP1__Norovirus__AJF21976

SEQ ID NO: 27452 - RNA, 1623 nt, Artificial Sequence
  derived and/or modified sequence opt5 from VP1__Norovirus__AJF21977
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugaagccaaucagaacaccaaauucacacccguuggggugauccaggacggaagcaccacacacagaaaugagccccaacaguggguccucccuuccuacagcggccggaacacgccgaaugugcaucuggcucccgccguggcgccuaccuuucccggcgaacagcuucuguucuuucgcucuacaaugccuggguguuccggauaucccaacauggaucucgacugccugcugccucaggaguggguucaauacuucuaucaggaggcugcccccgcccagagcgaugucgcucuccugagauuugugaauccggacaccggccgggugcuuuucgaauguaagcugcacaaaucuggguacgucacaguggcccauaccggacagcacgaucucguuauuccucccaacggcuauuuuagauucgacagcugggugaaccaauucuacacgcuggcuccuauggggaauggcaccggacgccggagagcccuuuga

SEQ ID NO: 27453 - RNA, 1623 nt, Artificial Sequence
  derived and/or modified sequence opt5 from VP1__Norovirus__AJF21978
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaaaccaaccagaauacaaaauucacccccguuggggugauccaggauggaggcacaacgcaccggaacgagccccaacaguggguccucccuagcuacuccggccgcaauaccccgaacgugcaccuggcccccgcuguggccccuacauuucccggggaacagcuucuguucuuuagaagcaccaugccuggauguucuggcuaucccaauacagaccucgauugccugcugccucaggaguggguucaauacuucuaucaggaggcggcucccgcccaguccgacgucgcccuccugcgguuugugaacccggauaccgggagagugcuuuucgaauguaagcugcauaaaagcggauacgucacgguggcucacaccggccagcaugaccucguuauuccucccaauggguauuuucgcuucgauucuugggugaaccaauucuacacacuggccccuaugggcaacggaaccggccggagacgcgcucuuuga

SEQ ID NO: 27454 - RNA, 1623 nt, Artificial Sequence
  derived and/or modified sequence opt5 from VP1__Norovirus__AJF21979
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccaaccacgauuuugaagccaaucagaacaccaaauucacacccguuggggugauccaggacggaggcaccacacacagaaaugagccccaacaguggguccucccuagcuacuccggccggaacacgccgaaugugcaucuggcucccgccguggcgccuaccuuucccggggaacagcuucuguucuuucgcagcacaaugccuggauguucuggcuaucccaacauggaucucgacugccugcugccucaggaguggguucaauacuucuaucaggaggcugcccccgcccaguccgaugucgcucuccugagauuugugaauccggacaccgggcgggugcuuuucgaauguaagcugcacaaaagcggauacgucacaguggcccauaccggccagcacgaucucguuauuccucccaacggguauuuuagauucgacucuugggugaaccaauucuacacgcuggcuccuaugggcaauggaaccggccgccggagagcccuuuga

SEQ ID NO: 27455 - RNA, 1623 nt, Artificial Sequence
  derived and/or modified sequence opt5 from VP1__Norovirus__AJF21980
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggaaugcuuacgcagaccacacggaccgacggcagcacacgcgggcacaaggccaccguguacacgggauccgcugauuuugccccuaagcugggcagaguccaauucgagacagacaccgaucaugacuuugaagccaaucagaacaccaaauucacacccguggggguuauccaggauggaucuaccacacaccggaaugagccccaacagugggugcucccuagcuacuccggccgcaacacgcacaauguccaucuggcuccggccguggcgcccaccuuuccuggcgaacagcuucuguucuuuagaagcacaaugcccggguguucuggauauccuaacauggaccucgauugccugcugccccaggagugggugcaauacuucuaucaggaggcugccccugcccaguccgacguugcucuccugcgguuugucaaucccgauaccggcagagugcuuuucgaauguaagcugcacaaaagcggguacgugacagucgcccauaccggacagcacgaccucgugauuccgccuaacggcuauuuucgcuucgauucuuggguuaaccaauucuacacgcuggcucccauggggaauggcaccggacggagacgcguggucuga

SEQ ID NO: 27456 - RNA, 1623 nt, Artificial Sequence; identical to SEQ ID NO: 27442
  derived and/or modified sequence opt5 from VP1__Norovirus__AJF21981

SEQ ID NO: 27457 - RNA, 1623 nt, Artificial Sequence; identical to SEQ ID NO: 27411
  derived and/or modified sequence opt5 from VP1__Norovirus__AJF21982

SEQ ID NO: 27458 - RNA, 1623 nt, Artificial Sequence
  derived and/or modified sequence opt5 from VP1__Norovirus__AJF21983
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuuagcccuaagcugggcagagugcaauucgagacagacaccgaucgggacuuugaagccaaccagaauaccaaauucacacccguuggggugauccaggauggaggcaccacacaucgcaacgagccccaacaguggguccucccuuccuacagcggcagaaaugccccgaacgugcaccuggcucccgccguggcgccuacguuucccggggaacagcuucuguucuuucggucuaccaugccuggauguuccggcuaucccaauauggaccucgauugccugcugccucaggaguggguucaauacuucuaucaggaggcugcccccgcccagagcgacgucgcucuccugagauuugugaacccggauacagggcgcgugcuuuucgaauguaagcugcacaaaucuggauacgucaccguggcccauacaggccagcacgaccucguuauuccucccaauggguauuuucgguucgauagcugggugaaccaauucuacacccuggcuccuaugggcaacggaacgggcagacgccgggcccuuuga

SEQ ID NO: 27459 - RNA, 1623 nt, Artificial Sequence
  derived and/or modified sequence opt5 from VP1__Norovirus__AJF21984
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagagccgacggcuccacccgggggcauaaggcuacagucuacaccggaucugccgauuuugccccuaagcugggccgcgugcaauucgagacggacacaaaccacgauuuugaagcuaaucagaacaccaaauucacccccguuggggugauccaggacggaggcacaacccacagaaaugagccccaacaguggguccucccuagcuacuccggccggaacacaccgaaugugcaucuggcccccgcgguggcuccuacguuucccggggaacagcuucuguucuuucgcagcaccaugccuggauguucuggcuaucccaacauggaucucgacugccugcugccucaggaguggguucaauacuucuaucaggaggccgcccccgcucaguccgaugucgcccuccugagauuugugaauccggacacagggcgggugcuuuucgaauguaagcugcacaaaagcggauacgucaccguggcucauacaggccagcacgaucucguuauuccucccaacggguauuuuagauucgacucuugggugaaccaauucuacacccuggccccuaugggcaauggaacgggccgccggagagcgcuuuga

SEQ ID NO: 27460 - RNA, 1623 nt, Artificial Sequence
  derived and/or modified sequence opt5 from VP1__Norovirus__AKE37037
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacguggggaaugaugcccccggauccacacgcgcgcaacaggccugggucagcaccuauuccccgcaguucgugccuaaacuuggcucugucaaccugagaauuagcgacaaugaugacuuucaguuccaacccacaaaguuuacccccguggggguuaacgaugacgaugacggacacccuuuccggcagugggaacucccgaauuacuccggcgagcugacgcuuaacaugaaucuggcucccccuguggcccccaacuuuccuggcgaacagcuccuguucuuucgcagcuucguccccugcucugggggauacaaccagggcaucaucgauugucugauuccucaagaguggauccagcauuuuuaucaggaauccgcccccagccagucugacguggcucucauuagauacguuaauccggauacagggcggacccuguucgaggccaagcugcacagaagcggauauaucaccguggcgcacuccggcgacuacccucuggucgugcccgcuaacgggcauuuucgcuucgacucuugggugaaucaauucuauagccucgccccuaugggcacaggaaacggccggagacgcgcccaguga

SEQ ID NO: 27461 - RNA, 1632 nt, Artificial Sequence
  derived and/or modified sequence opt5 from VP1__Norovirus__AKM20815
augaugauggccagcaaggacgcucccaccaacauggauggcacauccggggccggacagcuggugccugaggcgaauacggcugaaccgcuccccaucaaaccugucgccggcgccgcuaccgccguugcuacagccgggcaagugaacaugauugaccccuggaucaugaauaacuucgugcaggcgccucagggagaguuuaccauuucucccaauaacacaccuggcgauauccuguucgaccuucagcuggggccgcaccucaaucccuuucuggcccaucuuagcagaauguacaacggaugggucggcaauaugcaagugcggauuaugcuggcuggcaacgccuucuccgcugggaagaucaucguuugcuguauuccucccggauuuucuagccaguccaucucuauugcccaggcgaccauguucccucacgugaucgccgauguccgcgugcucgaacccauugacguuccgcuggaugacgugagaaauguccuguuucauaacaaugauaacccucagacaaugcggcuccugugcaugcuuuauacgccccugcgcagcggcgggaccuccagcggaaccgacccuuucgugaucgcuggcagagugcucacaugucccacccccgauuuuucuuuccuguuucuugucccuccggacauugagcaacggacaaaacccuucuccguuccuaauauccccaugaaccugaugagcaacucucgcguguccaugcucaucgaugggaugauggugagcaaugaccagaaccaggucccucaguuucaaaauggaagagugacccuggacggccagcugcagggcacgacaaccguuucugccgcuugcguggcccggaugcgcgggagaauuuucaacaauaacggaaauuacggcgucaaccucacagaacuggaugggaaucccuaucacgccuucgacuccccggcuccucuuggauuucccgauuucggcaacugugaccugcauaugaccuuugugaagaucaauccuaacgagcucagcuccggggaucccucuggaaaaguugugauucggagcuacgacgcgaccuucgccccucaccugggcacagucaaacuugagaaugaugacgaacuggcucgcuuugugggcaaggaggucgugcucgaacugacguggguuuccaacagagagggggccacccugaaucucugggccgugcccaacuauggaagcucucugacacaggcuucccaacuugccccgccuaucuacccucccggcuucggggaggcgauugucuauuuuaccagcacauuccccaccgugucuaacccgaagguucccugcacgcugccucaggaauuugugagccacuucgucaaugagcaggcucccacacggggagaugccgcccuccugcauuacguggacccugauacccaccgcaaccuuggcgaauuuaagauguaccccgagggguauaugaccugugugccuaaugcuggcggaggcccccaaacacugccgaucaacgggguuuucgucuuuaucuccugggugucuagauacuaucagcucaaaccugugggaaccgccggcgcugcccggagacuggggcugcgccggagcuga

SEQ ID NO: 27462 - RNA, 1623 nt, Artificial Sequence
  derived and/or modified sequence opt5 from vp1__Norovirus__AKM20818
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucagcuuucagacccaagaccgggauccuucccagagcgugaccuucgccacaaacgacgcuucuuuuguccccuaucucggauccgugagcccgcauaauggcgagggcuuccaggccggggauauuaucggaucucugggcuggauuagcgccccuuccgacaacucucaguuuaauguuugggcuauccccaaguacgggagcucccugcccgaugugacgcaccucgccccugcggucuucccgcccggauuuggcgaagugauucuguauuucuacagcaccuuuccugggucuggccaacccucccagcuucagguuccuugccugcucccccaggaguucaucacacacuuuuguaacgagcaagcuccuaucgccggagaagccgcucugcuucauuauguggaccccgauaccggccgcaaucugggggaguucaagcucuacccggacggauucaugacaugcgucccuaacagcgugucuuccggcccccagacccugccuauuaaugggguguuuguuuucgucagcuggguguccagauuuuaccagcugaaacccgugggaacggccucugcugcccggcgccucggccugagacggaucuga

SEQ ID NO: 27463 - RNA, 1623 nt, Artificial Sequence
  derived and/or modified sequence opt5 from VP1__Norovirus__ALD83748
augaagauggccagcaacgacgcugcccccuccaaugauggcgcgaccgggcuggugccugaggucaacaaugaaacacucccgcuggagcccguugcuggagccgccaucgcugccccugugacgggccagaacaauauuaucgaccccuggauuagaaccaacuucgugcaagcuccuaauggggaauuuacagucucuccccggaacagcccuggagagauccuucugaaucucgaacugggcccggaucuuaaccccuaccuggcccaccucucccgcauguauaauggguacgcgggaggcguggagguucaggugcugcuggccggcaacgcuuucaccgccgggaaaauucucuuugcugccgucccucccaauuucccuguggaguuucugucucccgcgcagaucacaaugcuuccgcaucugaucguugacgugagaacccucgaaccuauuaugaucccccugccugauguccggaacacauucuuucacuauaauaaccagcccaccaaccgcaugagacuuguggccaugcuguacacgccccuccggagcaauggauccggcgacgauguguucaccgucucuugccgcguucugacaagaccuaccccggacuuugaguucacauaucuggugcccccuagcguggaauccaagaccaaacccuuuagccucccuauucugacgaucucugagcuuacaaacucccgguuccccgucccgguggauagccuguuuaccgcucaaaauaacaaucucaacguucagugucagaaugggcgcugcacacuggacggagagcuucagggcaccacccaacugcagccuucugggauuugugccuucagaggaaagaucacagcugaugugcggcccaaccaugacgaucgcuggcacaugcagcucacgaaucugaacggcaccccuuucgaccccacagaagacgucccugcuccccugggcaccccggauuuuacagggcuccuguucggaguggccucccagagaaauguucaaccuaaccccaauaccacgcgggcccaugaggcggugauuagcacaaccucuucccaguuuguccccaaacuuggcagcaucaacuucggguccaccucugaagacuuuaucgugggacagccuacaaaguucaccccggucggcauuaagaucgaggaugggcacgccuuugaccaauggacacugccccgcuacagcggacaccucacgcugaauaugaaccuugcuccucccguggccccuaacuuccccggcgaacagcugcucuuuuucagauccaauguuccuugcgccggcgggauuagcgauggagugaucgacugucugcugccccaggaguggauucagcauuuuuaucaagagucugcuccgucccagagcgaugucgcccucauccgguacgugaacccugacaccggcagaacacuguucgaagcgaaacuucaccgcaccggguacaucacaguugcucauucuggagauuauccccugguggucccuagcaauggcuacuuucgguucgacuccugggugaaccaguucuauucucucgcccccauggggaccggcaauggaagacgccgggugcaguga

SEQ ID NO: 27464 - RNA, 1623 nt, Artificial Sequence
  derived and/or modified sequence opt5 from VP1__Norovirus__ALF12528
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucucacaacuacaccaugaaucucgccucccagaacuggaauagcuaugaucccacagaggaaauuccugcuccccugggcacgccggacuucguggggaaaauccagggaguccuuacccagacaaccagaacagacggcuccacccgggggcauaaggcgacgguguacacaggaucugccgauagcuccccuaagcugggccgcguucaauuugcuaccgacaccgauaacgacuucguggccaaucagaacacaaaauuuacccccgucggggugauucaggauggaggcacagcccacagaaaugagccccaacaguggguucucccuagcuacucuggccggaacacgcacaaugugcaucuggcuccggccgucgcgcccaccuucccuggggaacagcuucuguuuuuccgcuccacaaugcccggauguagcggcuauccuaacauggaccucgauugccugcugccccaggagugggugcaauacuuuuaucaggaagcugccccugcccagucugacguggcucuccugagauucguuaaucccgauaccgggcggguccuuuuugaguguaagcugcacaaaagcggauacgugacacaggcccauaccggccaacacgaccucgugaucccgccuaacggguauuucagauuugauuccugggucaaccaguucuacacgcuggcucccaugggcaauggaaccggccgccggagagcccuuuga

SEQ ID NO: 27465 - RNA, 1623 nt, Artificial Sequence
  derived and/or modified sequence opt5 from VP1__Norovirus__ALF12529
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuguuuucuccgccgugccucccaauuuuccuacggagggacugucucccagccaggucaccauguucccgcauaucaucguggacgugagacaacucgagccuguccugauuccccugccugauguucggaacaauuuuuaucacuacaaccaguccaaugaccccacaaucaagcucauugcuaugcuguauacaccccuucgcgccaacaacgcuggcgaugacguguucaccgugagcugcagaguccugacccggccuucuccggauuuugacuucaucuuucucgugcccccuacaguugaaucccgcaccaaacccuucagcgugccuauucugacggucgaggaaaugaccaauucuagauuucccaucccgcuugagaagcuguucacagggccuuccagcaccuucgugguucagccccagaacggacgguguacaaccgauggcgugcuccuggggacgacacaacugucuccugucaauauuugcaccuuucgcggagacgugacacauaucgccggcuccagaaacuacaccaugaaucucgccagccagaacuggaacuccuaugaucccaccgaggaaaucccugcuccccugggcacaccggacuucgucgggaaaauucagggagugcuuacgcagaccacacggaccgacggcucuacacgcgggcacaaggcgaccguuuacacgggaagcgccgauuuuuccccuaagcugggcagagugcaauucgcuacagacaccgauaaugacuuugaugccaaucagaacaccaaauucacacccgucggggugauccaggacggaaauaccgcccaucggaacgagccccaacaguggguucucccuagcuacucuggccgcaauacacacaacgugcaccuggcuccggccgucgcgcccacguuuccuggcgaacagcuucuguucuuuagauccaccaugcccggguguagcggauauccuaauauggaucucgacugccugcugccccaggagugggugcaauacuucuaucaggaagcugccccugcccagucugauguggcucuccugcgguuuguuaaccccgacacaggcagaguccuuuucgaguguaagcugcauaaaagcggguacgugaccguggcccacacaggacagcaugaucucgucauuccgccuaacggcuauuuucgcuucgacuccugggugaaucacuucuacacccuggcucccguugggaacggcacgggacggagacgcgcccuuuga

SEQ ID NO: 27466 - RNA, 1623 nt, Artificial Sequence
  derived and/or modified sequence opt5 from VP1__Norovirus__ALF12530
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucucacaacuacaccaugaaucucgcuucccagaacuggaauagcuaugaucccaccgaggaaauuccugcgccccugggcacaccggacuucguggggaaaauccagggaguccuuacgcagaccacaagagccgacggcuccacccgggggcauaaggcuacaguguacaccggaucugccgauuuuagcccuaagcugggccgcguucaauucgccacggacacaaacaaugauuuugacgcuaaccagaauaccaaauucacccccgugggggucauucaggauggagagacagcccacagaaacgaaccccaacagugggugcucccuuccuacagcggccggaauauccacaacguucaucuggcgccggcuguggcccccaccuuuccuggcgagcagcuucuguucuuucgcucuacaaugcccggguguuccggauauccuaauauggaacucgacugccugauuccccaggaguggguccaauacuucuaucaggaggccgcuccugcccagagcgauguggcucugcucagauuugugaaccccgacacgggccggguucuguucgaauguaaacuucacaagucuggguacgucaccguggcccauacaggacagcacgaucuggugaucccgccuaacggcuauuuuagauucgacagcugggucaaucaauucuacacccucgcgcccauggggaacggcacaggacgccggagagcccuguga

SEQ ID NO: 27467 - RNA, 1623 nt, Artificial Sequence
  derived and/or modified sequence opt5 from VP1__Norovirus__ALF12531
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagaagcuguucaccgggccguccagcgccuucgucgugcagccucagaacggacgguguacaaccgauggcguucuccuggggacgacacaacugucucccgugaauaucugcaccuuucgcggagacgucacacauaucgccggcuccagaaacuacaccaugaaucucgcuagccagaacuggaacuccuaugauccuaccgaggaaauucccgcgccucuggagacacccgacuucgugggcaaaauccaggggguccuuacgcagaccacacggaccgacggaucuacacgcggccacaaggccaccguguacacggggagcgcugauuuuuccccgaagcugggaagaguucaauucgccacagacaccgauaaugacuuugauagcaaucagaacaccaaauucacaccugugggcgucauucaggacgggggaaccacacaucggaaugaaccccaacagugggugcuccccucuuacuccggccgcgauauccacaacguucaccuggccccugcuguggccccgacguuucccggcgagcagcuucuguucuuuagaagcaccaugccuggguguucuggauaucccaauauggaccucgauugccugcugccucaggaauggguccaauacuucuaucaggaggcggcucccgcccagagcgacguggcccuccugcgguuugugaacccugauacaggcagaguucuuuucgaguguaagcugcauaaauccggguacgucaccguggcucacacaggacagcaugaccucgugauucccccgaauggcuauuuucgcuucgacucuugggucaaccaauucuacacccuggccccuauggggaacggcacgggacggagacgcgugcuuuga

SEQ ID NO: 27468 - RNA, 1623 nt, Artificial Sequence
  derived and/or modified sequence opt5 from VP1__Norovirus__ALF12532
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgcuauugacccuuggaucagaaauaacuucgugcaggcccccggcggggaauuuacaguuuccccucggaaugcgcccggagagauucuguggucugccccucuuggcccggaucugaaccccuaccucagccaccuggcucgcauguauaauggguacgccggaggcuucgaagugcaggucauccuugcuggcaacgccuuuacggcggggaaaauuaucuucgccgcugugccucccaauuuuccuaccgagggacugucccccucucagguuacaauguucccgcauaucauuguggacgucagacaacucgagccugugcugaucccccugccugaugugcggaacaauuuuuaucacuacaaccagagcaaugacuccaccauuaagcucaucgccaugcuguauacaccccuucgcgcuaacaacgccggcgaugacgucuucaccguuagcugcagagugcugacacggcccucuccugauuuugacuucauuuuucucgugccgcccaccgucgaaucccgcacgaaaccuuucagcgugcccauccugaccguugaggaaaugacaaauucuagauuuccuauuccccuugagaagcuguucaccgggccguccagcgccuucgugguccagccucagaacggacgguguacaaccgauggcgugcuccuggggacgacacaacugucucccguuaauaucugcaccuuucgcggagacgugacacauaucgcuggcuccagaaacuacaccaugaaucucgcgagccagaacuggaacuccuaugauccuaccgaggaaauucccgccccucugggcacacccgacuucgucgggaaaauccagggagugcuuacgcagaccacacggaccgacggcucuacacgcgggcacaaggcuaccgucuacacgggaagcgccgauuuuuccccgaagcugggcagagugcaauucgccacagacaccgauaaugacuuugaugcuaaucagaacaccaaauucacaccuguuggggugauucaggacggaggcaccacacaucggaaugagccccaacaguggguccuccccagcuacucuggccgcaacauccacaaugugcaccuggccccugcgguugcuccgacguuucccggggaacagcuucuguucuuuagauccaccaugccuggauguagcggcuaucccaacauggaucucgacugccugcugccucaggagugggugcaauacuucuaucaggaagccgcccccgcucagucugaugucgcccuccugcgguuugugaauccugacacagggagagugcuuuucgaguguaagcugcauaaaagcggauacguuaccgucgcucacacaggccagcaugaucucgugauucccccgaacggguauuuucgcuucgacuccugggugaaccaauucuacacccuggccccuaugggcaauggaacgggccggagacgcgcgcuuuga

SEQ ID NO: 27469 - RNA, 1623 nt, Artificial Sequence
  derived and/or modified sequence opt5 from VP1__Norovirus__ALF12533
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaccuucgcggccguuccucccaauuuuccuacagagggacugucccccucucaggugaccauguucccgcauaucaucgucgacgugagacaacucgagccugugcugauuccccugccugauguccggaacaauuuuuaucacuacaaccagagcaaugaccccacaaucaagcucauugcuaugcuguauacaccccuucgcgccaacaacgcuggcgaugacguuuucaccguguccugcagagugcugacccggccuagcccggauuuugacuucaucuuucucgugcccccuacggucgaaucucgcaccaaacccuucuccguuccuauucugacaguggaggaaaugaccaauagcagauuucccaucccgcuugagaagcuguucacagggccuucuuccaccuucgucgugcagccccagaacggacgguguacgacagauggcguucuccuggggaccacacaacugagcccugugaauauuugcaccuuucgcggagacgucacccauaucacaggcucucacaacuacacgaugaaucucgccucccagaacuggagcuccuaugaucccaccgaggaaaucccugcuccccugggcacaccggacuucguggggaaaauucagggaguccuuacccagacaaccagaacggacggcucuacacgggggcauaaggccaccguguuuaccggaagcgcggauuucuccccuaagcugggccgcguucaauuugccacagacaccgauaaugacuucguggcuaaccagaauacaaaauuuacgcccgucggggugauccaggauggaggcaccgcccacagaaacgagccccaacaguggguucucccuagcuacucuggccggaauauucacaacgugcaucuggccccggcugucgcccccacauucccuggggaacagcuucuguuuuuccgcuccaccaugcccggauguagcggcuacccuaauauggaccucgauugccugcugccccaggagugggugcaauauuuuuaccaggaagcggcuccugcccagucugacguggcccuccugagauucguuaaccccgauacagggcggguccuuuuugaguguaagcugcacaaaagcggauaugugaccguggcucauacgggccagcacgaccucgucaucccgccuaauggguacuucagauucgauuccugggugaaccaauuuuauacccuggcccccaugggcaacggaacaggccgccggagagcucuuuga

SEQ ID NO: 27470 - RNA, 1623 nt, Artificial Sequence
  derived and/or modified sequence opt5 from VP1__Norovirus__ALF12534
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuuuagccuggcuccuauggggaacggcacgggacggagacgcgcccuuuga

SEQ ID NO: 27471 - RNA, 1623 nt, Artificial Sequence
  derived and/or modified sequence opt5 from VP1__Norovirus__ALF12535
augaagauggccagcuccgacgcuaaccccucugugggcagcgccgcgaaucuggucccugagguuaacaaugaagugauggcucucgagccgguggucggggccgccaucgcugcccccguggcuggacagcaaaacguuauugauccuuggaucagaaauaacuucgugcaggcccccggcggggaauuuaccgucuccccucggaaugcgcccggagagauucuguggucugccccucuuggcccggaccugaaccccuaccucagccaccuggcucgcauguauaauggguacgccggaggcuucgaagugcuuguuauccuggcuggcaacgccuuuacagcggggaaaauuaucuucgccgcugugccucccaauuuuccuacggagggacucucccccucucaggucaccauguucccgcauaucauuguggaugugagacagcuggagccuguccugaucccccucccugacguucggaacaauuuuuaucacuacaaccaaagcaaugaucccacaauuaagcugaucgccaugcuuuauacaccccugcgcgcuaacaacgccggcgacgauguguucaccguguccugcagaguccucacccggccuagcccggacuuugauuucauuuuucuggugcccccuacaguugaaucucgcaccaaacccuucuccgugccuauccuuacggucgaggaaaugaccaauagcagauuucccauuccgcuggagaagcuguucacagggccuucuuccgccuucgugguucagccccagaacggacgguguaccacagacggcgugcugcuggggaccacgcagcucagcccugucaauaucugcacauuucgcggagaugugacccauacaaccggcucucacaacuacaccaugaaucuggcuacacaaaacuggaacuccuaugaccccacggaggaaaucccugcgccccuuggcaccccggauuucgucgggaaaauucagggagugcugacacagaccacaaagaccgacggcagcacgagagggcauaaggccacaguuuacaccggauccgcugacuuugccccuaaacucggccgggugcaguucgccaccgauacagacaaugauuuugaggcuaaucaaaacaccaaguucacacccgucggggugauccaggacggaggcacggcccaccgcaaugaaccccagcaauggguucugccuucuuacagcggcagaaacacccacaaugugcaucuugcgccggcugucgcccccacauuuccuggggagcagcuccucuucuuucgguccaccaugcccggauguagcggcuauccuaacauggaucuggacugccugcucccccaggaaugggugcaguacuucuaucaagaggccgcuccugcccagucugauguggcucugcuucgcuuuguuaaucccgacacagggagaguccuguucgaguguaaacuccacaaguccggauacgugaccguggcccauacgggcccgcacgaucuggucauuccucccaacggguauuuucgguucgacagcugggugaaccaguucuacacccuugcgccuaugggcaauggaacaggcagacgccgggcccuguga

SEQ ID NO: 27472 - RNA, 1623 nt, Artificial Sequence
  derived and/or modified sequence opt5 from VP1__Norovirus__ALF12536
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacgucacccauacaaccggcucucacaacuacaccaugaaucucgcuacacagaacugguccagcuaugaucccacggaggaaaucccugcgccccugggcaccccggacuucguggggaaaauucagggaguccuuacacagaccacaaagaccgacggcuccacgagagggcauaaggccacaguguacaccggaucugcugauuuugccccuaaacugggccggguucaauucgccaccgacacagauaaugacuuugaggcuaaccagaauaccaaguucacacccgugggggucauccaggauggaaacacggcccaccgcaaugaaccccaacagugggugcucccuagcuacuccggcagaaacacccacaauguucaucuggcgccggcuguggcccccacauuuccuggcgagcagcuucuguucuuucggagcaccaugcccggguguucuggauauccuaacauggaccucgauugccugcugccccaggaauggguccaauacuucuaucaggaggccgcuccugcccaguccgacguggcucuccugcgcuuugugaaucccgauacaggcagaguucuuuucgaguguaaacugcacaagagcggguacgucaccguggcccauacgggaccgcacgaccucgugauuccucccaacggcuauuuucgguucgauucuugggucaaccaguucuacacccuggcgccuauggggaauggcacaggaagacgccgggcccuuuga

SEQ ID NO: 27473 - RNA, 1623 nt, Artificial Sequence
  derived and/or modified sequence opt5 from VP1__Norovirus__ALF12537
augaagauggccagcuccgacgcuaaccccucugauggcagcaccgccaaucuggcgccugaggugaacaaugaagucauggcucucgagccgguugugggggccgccaucgcugcccccguggcuggacagaaaaacgucauugacccuuggaucagaaauaacuucgugcaagcccccggcggggaauuuacaguuuccccucggaaugcgcccggagagauucuguggucugccccucuuggcccggaucugaaccccuaccucagccaccuggcucgcauguauaauggguacgccggaggcuucgaagugcaggucauccuugcuggcaacgccuuuacggcggggaagauuaucuucgccgcugugccucccaauuuuccuaccgagggacugucccccucucagguuacaauguucccgcauaucauuguggacgucagacagcucgagccugugcugaucccccugccugaugugcggaacaauuuuuaucacuacaaccaaagcaaugaccccaccauuaaacucaucgccaugcuguauacaccccuucgcgcuaacaacgccggcgaugacgucuucaccguuuccugcagagugcugacacggccuagcccggauuuugacuucauuuuucucgugcccccuaccgucgaaucucgcacgaagcccuucuccgccccugugcugaccguugaggaaaugacaaauagcagauuucccaucccgcuugagaaacuguucaccgggccuucuuccgcuuucgugguccagccccagaacggacgguguacaaccgauggcgugcuccuggggacgacacagcugagcccuguuaauauuugcaccuuucgcggagacgugacacauaucucuggcuccagaaacuacaccaugaaucucgcgagccaaaacuggaacuccuaugaucccaccgaggaaaucccugcuccccugggcacaccggacuucgucgggaagauucagggagugcuuacgcagaccacacggaccaauggcucuacacgcgggcacaaggccaccgucuacacgggaagcgccgacuuuuccccuaaacugggcagagugcaguucgccacagauaccgacaaugauuuugagaccaaccaaaauacaaaguucacccccguuggggugauccaggacggaagcacaacgccccggaacgaaccucagcaauggguccucccgucuuacuccggccgcaauacccauaacgugcaccuggcucccgccguugcgccuacauuucccggcgagcagcuucuguucuuuagaagcaccaugccuggguguucuggauaucccaauauggaucucgacugccugcugccucaggaaugggugcaguacuucuaucaagaggcugcccccgcccagagcgaugucgcucuccugcgguuugugaacccggacacaggcagagugcuuuucgaguguaaacugcacaaguccggguacguuaccgucgcccauacgggacagcgcgaucucgugauuccucccaacggcuauuuucgguucgacucuugggugaaucaguucuacagccuggcuccuauggggaacggcaccggaagacgccgggcccuuuga

SEQ ID NO: 27474 - RNA, 1623 nt, Artificial Sequence
  derived and/or modified sequence opt5 from VP1__Norovirus__ALF12538
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccgggccuuccagcgcuuucgucgugcagccccagaacggacgguguucuacagauggcguucuccuggggaccacgcaacuguccccugugaauaucugcacauuucgcggagacgucacccauaucgccggcagccacaacuacacaaugaaucucgccucccagaacuggucuagcuaugaucccaccgaggaaauuccugcuccccugggcaccccggacuucguggggaaaauccagggaguccuuacacagacgaccagauccgacggcagcacacgggggcauaaggcgaccguguacacaggaucugccgauuuuuccccuaagcugggccgcguucaauucgcuaccgacacggauaaugacuuugugagcaaccagaauacaaaauucacccccgucggggugauucaggauggagacaccgcccacagaaacgagccccaacaguggguucucccuucuuacagcggccggaauauccacaacgugcaucuggccccggcugucgcccccacauuuccuggcgaacagcuucuguucuuucgcuccaccauucccggguguucuggauauccuaauauggaucucgacugccugcugccccaggagugggugcaauacuucuaucaggaagcggcuccugcccagagcgauguggcccuccugagauuuguuaaccccgacacaggccggguccuuuucgaguguaagcugcacaaauccggguacgugacgguggcucauaccggacagcacgaucucgucaucccgccuaauggcuauuuuagauucgacagcugggugaaccacuucuacacacuggcccccauggggaacggcaccggacgccggagaguucuuuga

SEQ ID NO: 27475 - RNA, 1623 nt, Artificial Sequence
  derived and/or modified sequence opt5 from VP1__Norovirus__ALF12539
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgagaaucauugucgacgugcggcaacucgagccugugcugaucccccugccugauguccgcaacaauuuuuaucauuacaaccagagcaaugaccccaccauuaagcucaucgcuaugcuguauacaccccuuagagccaacaacgcuggcgaugacguuuucaccguguccugccgggugcugacacgcccuagcccggauuuugacuucauuuuucucgugcccccuaccgucgaaucuagaacgaaacccuucuccguuccuauccugaccguggaggaaaugacaaauagccgguuucccauuccgcuugagaagcuguucaccgggccuucuuccgccuucgucgugcagccccagaacggacgcuguagcacagauggcguucuccuggggaccacgcaacugucuccugugaauaucugcacauuuagaggagacgucacccacaucgccggcucccauaacuacacaaugaaucucgcuagccagaacugguccucuuaugaucccaccgaggaaauuccugcgccccugggcaccccggacuucguggggaaaauccagggaguccuuacacagacgacccggacagacggcagcacccgcgggcacaaggccacaguguacaccggauccgcugauuuuagcccuaagcugggcagaguucaauucgccacggacacaaauaacgauuuugagucuaaucagaacaccaaauucgcccccgugggggucauucaggacggaggcaccgcucaucggaaugaaccccaacagugggugcucccuuccuacagcggccgcaacauccacaauguucaccuggccccggcgguggcucccacauuuccuggggagcagcuucuguucuuuagaucuaccauucccggauguagcggcuauccuaacauggaucucgacugccugcugccccaggaauggguccaauacuucuaucaggaggccgccccugcucaguccgauguggcccuccugcgguuugugaaucccgacacagggagaguucuuuucgaguguaagcugcauaaaucuggauacgucacgguggcucacaccggccagcaugaucucgugaucccgccuaacggguauuuucgcuucgacagcugggucaaccaauucuacacacuggcccccaugggcaauggaaccggccggagacgcgcgcuuuga

SEQ ID NO: 27476 - RNA, 1623 nt, Artificial Sequence
  derived and/or modified sequence opt5 from VP1__Norovirus__ALF12541
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuuguuggcaacgccuuuacggcugggaaaauuaucuucgccgcggugccucccaauuuuccuaccgagggacugucccccucucaggucacaauguucccgcauaucauuguggacgugagacaacucgagccuguccugaucccccugccugauguucggaacaauuuuuaucacuacaaccagagcuccgacagcaccauuaagcucaucgccaugcuguauacaccccuucgcgcuaauaacgccggcgaugacguguucaccgugucuugcagaguccugacacggcccuccccugauuuugacuucauuuuucucgugccgcccaccguugaaagccgcacgaaaccuuucucugugcccguccugaccguggaggaaaugacaaacuccagauuuccuaucccccuugagaagcuguucaccgggccgagcucugcuuucguugugcagccucagaauggacgguguacaaccgauggcguccuccuggggacgacacaacugucccccgugaacauuugcaccuuucgcggagacgucacacauaucagcggcucccacaauuacaccaugaaccucgccucucagaauuggaacagcuaugauccuaccgaggaaauccccgccccucugggcacacccgacuucguggggaaaauucagggaguucuuacgcagaccacaagaaccgacggcuccacacgggggcauaaggcuaccguguacacgggaagcacagauuuuaccccgaagcugggccgcgcgcaauucgccaccgacacagauaaugacuuugagaccaaccagaauacaaaauucacgccugucggggugauccaggauggaggcaccacacacagaaacgaaccccaacaguggguucuccccucuuacuccggccggaauacccacaacgugcaucuggcuccugccgucgccccgacauuucccggggagcagcuucuguucuuucgcagcaccaugccuggauguucuggcuaucccaauauggaccucgauugccugcugccucaggaaugggugcaauacuucuaucaggaggcugcccccgcgcagagcgacguggcucuccugagauuuguuaacccugauacggggcggguccuuuucgaguguaagcugcacaaauccggauacgugaccguggcccauacaggccagcacgaccucgucauucccccgaauggguauuuuagauucgauucuugggugaaccaauucuacacccuggccccuaugggcaacggaacaggccgccggagagcucuuuga

SEQ ID NO: 27477 - RNA, 1623 nt, Artificial Sequence
  derived and/or modified sequence opt5 from VP1__Norovirus__ALF12542
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccgggcugacggcagcacacgcgggcacaaggccaccguguacacaggauccgccgauuuugcuccuaagcugggcagaguccaauucgagaccgacacggaucaugacuuugaagccaaucagaacacaaaauucacccccguggggguuauccaggauggaucuaccacacaccggaaugagccccaacagugggugcucccuagcuacuccggccgcaacacccacaauguccaucuggcgccggcuguggcccccacauuuccuggcgaacagcuucuguucuuuagaagcacgaugcccggguguucuggauauccuaacauggaccucgauugccugcugccccaggagugggugcaauacuucuaucaggaggccgcuccugcccaguccgacguugcucuccugcgguuugucaaucccgauaccggcagagugcuuuucgaauguaagcugcacaaaagcggguacgugacagucgcccauaccggacagcacgaccucgugauuccgccuaacggcuauuuucgcuucgauucuuggguuaaccaauucuacacacuggcgcccauggggaauggcgccggacggagacgcgcucuuuga

SEQ ID NO: 27478 - RNA, 1623 nt, Artificial Sequence
  derived and/or modified sequence opt5 from VP1__Norovirus__ALF12543
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacugugauccuaccgaggaaauccccgcgccucugggcacacccgacuucgucgggaaaauucagggaaugcuuacgcagaccacacggaccgacggcuccacacgcgggcacaaggccaccguguauacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuucuguucuuuagaucuacaaugccugggugcuccggauaccccaacauggaccucgauugucugcugccucaggaguggguccaauauuucuaccaggaggcugcccccgcccagagcgacguggcucuccugcgguuugugaauccugauaccggcagaguucuuuucgaaugcaagcugcacaaaucuggguaugucacaguggcccauaccggacagcacgaccucgugauucccccgaacggcuacuuucgcuucgauagcugggucaaccaauucuauacgcuggcuccuauggggaauggcaccggacggagacgcgcccuuuga

SEQ ID NO: 27479 - RNA, 1623 nt, Artificial Sequence
  derived and/or modified sequence opt5 from VP1__Norovirus__ALF12546
augaagauggccagcuccgacgcuaaccccucugagggcagcaccgccucccuggugccugaagucaauaacgagguuauggcgcucgaaccgguggcuggggccgccaucgcugcccccguggcuggacaggucaaugugauugauccuuggaucagaaacaauuucguucaagcccccggcggggaguuuacagugucuccucggaacgcgcccggagaaauucuguggagcgccccucuuggcccggaccugaaucccuaccucucccaccuggcucgcauguauaacggguacgccggaggcuucgagguccaggugauccuugcuggcaaugccuuuacggcggggaaaauuaucuucgccgcuguuccucccaacuuuccuaccgagggacugucucccagccaggugacaauguucccgcauaucauugucgaugugagacagcucgaaccugugcugaucccccugccugacguccggaauaacuuuuaucacuacaaucaauccaacgagcccaccauuaagcucguugccaugcuguauacaccccuucgcgcuaauaacgccggcgaugacguguucaccgugagcugcagaguccugacacggccuucuccggauuuugacuucaucuuucucgugcccccuaccguugaaucccgcacgaaacccuucagcgugccuauucugaccgucgaggagaugacaaacucuagauuucccaucccgcuugaaaagcuguucaccgggccuuccagcucuuucgugguucagccccagaauggacgguguacaaccgauggcgugcuccuggggacgacacagcuguccccugucaacauuugcaccuuucgcggagacgugacacauaucagcggcuccagaaaucacaccaugaaccucgccucucaaaauuggaacagcuacgaucccaccgaggaaaucccugcuccccugggcacaccggacuucgucgggaaaauucagggagugcuuacgcagaccacacgguccgauggcagcacccgcgggcauaaggcgacaguuuauaccggaucugccgacuuuuccccuaagcugggcagaauccaguucgcuacggacacagauaaugacuuugagaccaaccaaaauaccaaauucacacccgugggggucauucaggauggaggcaccacacaccggaacgaaccccagcaaugggugcucccuacguacagcggccgcaauacccacaacguucaucuggccccggccguggcucccacauuuccuggggagcagcuucuguucuuuagaucuaccaugcccggauguagcggcuacccugacauggaucucgacugccugcugccccaggaguggguccagcacuucuaucaagaagccgcgccugcucaguccgauguggcccuccugcgguuugugaaucccgacacagggagaguucuuuucgaguguaagcugcauaaagccggauacgucaccguggcucacacgggccagcacgaucucgugaucccgccuaacggguauuuucgcuucgacucuugggucaaucaguucuuuacccuggcccccaugggcaacggaacaggccggagacgcgcucuuuga

SEQ ID NO: 27480 - RNA, 1623 nt, Artificial Sequence
  derived and/or modified sequence opt5 from VP1__Norovirus__ALF12547
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccugugcugacggucgaggaaaugaccaauagcagauuucccaucccgcuugagaagcuguucacagggccuucuuccgccuucgugguucagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaaucccugcgccccugggcacaccggacuucgucgggaaaauucagggaaugcuuacgcagaccacacggaccgacggcagcacacgcgggcacaaggccaccguguacacgggauccgcugauuuugccccuaagcugggcagaguucaauucgagacagacaccgaucaugacuuugaagccaaucagaacaccaaauucacacccgugggggucauccaggauggaucuaccacacaccggaaugagccccaacagugggugcucccuagcuacuccggccgcagcgcucacaacguucaucuggccccggcgguggcucccacguuuccuggcgaacagcuucuguucuuuagaucuaccaugcccggguguuccggauauccuaauauggaccucgauugccugcugccccaggaguggguccaauacuucuaucaggaggccgccccugcucagagcgacguggcccuccugcgguuugugaaccccgauacaggcagaguucuuuucgaauguaagcugcacaaaucuggguacgucaccguggcucauacaggacagcacgaccucgugauuccgccuaauggcuauuuucgcuucgauagcugggucaaccaauucuacacccuggcccccauggggaacggcacgggacggagacgcgcgcuuuga

SEQ ID NO: 27481 - RNA, 1623 nt, Artificial Sequence
  derived and/or modified sequence opt5 from VP1__Norovirus__ALF12560
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauagcgcuggcgaugacguuuucaccgugucuugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccgggccuagcucugccuucgucgugcagccccagaacggacgguguacaaccgauggcguucuccuggggacgacacaacuguccccugugaauaucugcagcuuucgcggagacgucacccauaucgccggcuccagaaacuacacaaugaaucucgcuucucagaacuggaauagcuaugaucccaccgaggaaauuccugcgccccugggcaccccggacuucguggggaaaauccagggaguccuuacacagacgacccggacagacggcuccacccgcgggcacagagccacaguguacaccggaagcgcugauuuuucuccuaagcugggccggguucaauucgccacggacacagauaacgacuuuguggccaaucagaacaccaaguucacccccgucggggugauucaggauggagacacagcucaucgcaaugagccccaacaguggguucucccuuccuacagcggcagaaacauccacaaugugcaccuggccccggcggucgcucccaccuuuccuggcgaacagcuucuguucuuucggucuacaaugcccggguguagcggauauccuaacauggaucucgacugccugcugccccaggagugggugcaacauuucuaccaggaagccgccccugcucaguccgauguggcccuccugagauuuguuaaucccgacacgggccgcguccuuuucgaguguaaacugcacaagucuggguaugugaccguggcucauacaggacagcacgaucucgucauuccgccuaacggcuacuuucgguucgacagcugggugaaucaauucuauacccuggcccccauggggaacggcacaggaagacgccgggcgcuuuga

SEQ ID NO: 27482 - RNA, 1623 nt, Artificial Sequence
  derived and/or modified sequence opt5 from VP1__Norovirus__ALF12562
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucuacgccucuuggcccggaucugaaccccuaccucagccaccuggcgcgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccugugcugacagucgaggaaaugaccaauagcagauuucccaucccgcuugagaagcuguucacagggccuucuuccgcuuucgugguucagccccagaacggacgguguaccacggauggcgugcuccuggggacaacccaacugagcccugucaauauuugcacauuucgcggagacgugacccauaucucuggcuccagaaacuacaccaugaaucucgccagccagaacuggaacuccuaugaucccacagaggaaaucccugcuccccugggcacgccggacuucgucgggaaaauucagggagugcuuacccagacaacccggacagacggcucuacccgcgggcacaaggccacgguuuacacaggaagcgcggauuuuuccccuaagcugggcagagugcaauucgccaccgacaccgauaaugacuuugagacaaaucagaacaccaaauucacacccgucggggugauccaggauggaagcacgacccaucggaaugaaccccaacaguggguucucccuucuuacuccggccgcaacacacacaaugugcaccuggcuccggccgucgcccccaccuuuccuggcgagcagcuucuguucuuuagaagcacaaugcccggguguucuggauauccuaacauggaccucgauugccugcugccccaggaaugggugcaauacuucuaucaggaggcugccccugcgcagagcgacguggcucuccugcgguuuguuaaucccgauaccggcagaguccuuuucgaguguaagcugcauaaauccggguacgugacgguggcccacaccggacagcaugaccucgucauuccgccuaacggcuauuuucgcuucgauucuugggugaaccaauucuacacacuggcccccauggggaauggcaccggacggagacgcgcucuuuga

SEQ ID NO: 27483 - RNA, 1623 nt, Artificial Sequence
  derived and/or modified sequence opt5 from VP1__Norovirus__ALF12564
augaagauggccagcuccgacgcuaacucuagcgauggcuccgccgcgaaucuggugcccgaggucaacaaugaaguuauggcucucgagccuguggugggggccgccaucgcugccccggucgcuggacagcaaaacgugauugaccccuggaucagaaauaacuucguucaggccccuggcggggaauuuaccgugucuccccggaaugcgccuggagagauucuguggagcgcuccccuuggcccugaucugaacccguaccucucccaccuggcccgcauguauaauggguacgccggaggcuucgaaguccaggugauccuugcuggcaacgccuuuacagcggggaaaauuaucuucgccgcuguucccccuaauuuucccacggagggacugucuccuagccaggugaccauguucccccauaucauugucgacgugagacaacucgagccggugcugaucccucugcccgauguccggaacaauuuuuaucacuacaaccaguccaaugacccuacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccauccugacgguggaggaaaugaccaauucuagauuuccuauuccccuugagaagcuguucacagggccguccagcgccuucgucgugcagccucagaacggacgguguaccacagauggcguucuccuggggaccacgcaacugucucccgugaauaucugcacauuucgcggagacgucacccauaucacaggcuccagaaacuacaccaugaaucucgcuacccagaacuggaauagcuaugauccuacagaggaaauucccgcgccucugggcacgcccgacuucguggggaaaauccagggaguccuuacccagacaaccaagacagacggcuccacccgggggcacaaggccacgguguacacaggaucugcugauuuugccccgaaacugggccgcguucaauucgccaccgacaccgauaacgacuuugaggcuaaucagaacacaaaguucaccccugugggggucauucaggauggaggcacaacgcauagaaaugaaccccaacagugggugcuccccagcuacuccggccggaacacccacaauguucaccuggccccugcgguggcuccgacauuucccggggagcagcuucuguucuuucgcagcaccaugccuggauguucuggcuaucccaacauggaccucgauugccugcugccucaggaauggguccaauacuucuaucaggaggccgcccccgcucaguccgacguggcccuccugagauuugugaauccugauacagggcggguucuuuucgaguguaaacugcauaagagcggauacgucaccguggcucacacgggcccccaugaccucgugaucccgccuaacggguauuuuagauucgauucuugggucaaccaguucuacacccuggcccccaugggcaauggaacaggccgccggagagcgaccuga

SEQ ID NO: 27484 - RNA, 1623 nt, Artificial Sequence
  derived and/or modified sequence opt5 from VP1__Norovirus__ALF12566
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagagauaauuucguucaggcccccggcggggaauuuaccguguccccucggaacgcgcccggagagauucuguggucugccccucuuggcccggaccugaaucccuaccucagccaccuggcucgcauguauaacggguacgccggaggcuucgaaguccaggugauccuugcuggcaaugccuuuacagcggggaaaguuauuuucgccgcugugccucccaacuuuccuacggagggacugucccccucucaggucaccauguucccgcauaugaucguggaugugagacaacucgagccuguccugaucccccugccugacguucggaauaacuuuuaucacuacaaucagagcaacgaucccacacucaagcugauugccaugcuuuauacaccccugcgcgcuaauaacgccggcgacgauguguucaccguguccugcagaguccucacccggccuagcccggacuuugauuucaucuuucuggugcccccuacaguugaaucucgcaccaaacccuucuccgugccuguccuuacgguggaggaaaugaccaacagcagauuucccauuccgcuggagaagcuguucacagggccuucuuccgccuucguugugcagccccagaauggacgguguaccacagacggcguccugcuggggaccacgcaacucagcccugugaacaucugcacauuucgcggagaugucacccauauuacaggcucuagaaauuacaccaugaaccuggcuucccagaauuggaacaauuaugaccccaccgaggaaaucccugcgccccuuggcgccccggacuucguggggaaaauucagggaaugcugacacagacgacccggacagauggcagcacccgcgggcacaaggcuacaguuuacaccggauccgccgacuuugccccuaagcucggcagagugcaauucgagacggauacagaccaugauuuugaagcuaaccagaauaccaaauucacccccgucggggugauccaggacggaucuacaacccaccggaacgagccccaacaguggguucugccuagcuacuccggccgcaauacacacaacgugcaucuugccccggcggucgcucccacguuuccuggcgaacagcuccucuucuuuagaagcaccaugcccggguguucuggauauccuaauauggaucuggacugccugcucccccaggagugggugcaauacuucuaucaggaggccgccccugcucaguccgauguggcccugcuucgguuuguuaaccccgacacaggcagaguccuguucgaauguaagcuccacaaaagcggguacgugaccguggcucauacaggacagcacgaucuggucaucccgccuaauggcuauuuucgcuucgacucuugggugaaccaauucuacacccuugcccccauggggaacggcacgggacggagacgcauuguuuga

SEQ ID NO: 27485 - RNA, 1623 nt, Artificial Sequence
  derived and/or modified sequence opt5 from VP1__Norovirus__ALF12569
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucagcguucccgugcugacggucgaggaaaugaccaauucuagauuuccuaucccccuugagaagcuguucacagggccguccagcgccuucgugguucagccucagaacggacgguguaccacagauggcgugcuccuggggaccacgcaacugucucccgucaauauuugcacauuucgcggagacgugacccauaucacaggcuccagaaacuacaccaugaaucucgcuagccagaacuggaauaacuaugauccuaccgaggaaauccccgcgccucugggcacacccgacuucgucgggaaaauucagggaaugcuuacgcagaccacacggaccgacggcuccacacgcgggcacaaggccaccguguacacgggaucugcugauuuugccccgaagcugggcagaguucaauucgagacagacaccgaucaugacuuugaagccaaucagaacaccaaauucacaccugugggggucauccaggauggaagcaccacacaccggaaugagccccaacagugggugcuccccuccuacagcggccgcaacacgcacaauguucaucuggcuccugccguggcgccgaccuuucccggcgaacagcuuccuuucuuuagaucuacaaugcccggguguuccggauauccuaacauggaccuggauugccuccugccccaggaguggguccaauacuucuaucaggaggcugccccugcccagagcgacguggcucugcuccgguuugugaaucccgauaccggcagaguucuguucgaauguaaacuucacaagucuggguacgucacaguggcccauaccggacagcacgaccuggugauuccgccuuauggcuacuuucgcuucgauagcugggucaaccaauucuauacgcucgcucccauggggaacggcaccggacggagacgcgcccuguga

SEQ ID NO: 27486 - RNA, 1623 nt, Artificial Sequence; identical to SEQ ID NO: 27460
  derived and/or modified sequence opt5 from VP1__Norovirus__ALQ28762

SEQ ID NO: 27487 - RNA, 1632 nt, Artificial Sequence
  derived and/or modified sequence opt5 from VP1__Norovirus__ALS03883
augaagauggccagcaacgacgcugcccccuccaaugauggcgcggcugggcuggugccugagaucaacaaugaaaccauggcccucgagccggucgccggaggcgcuauugccgcuccccugacagggcagacgaacuucaucgacccuuggauuagaggaaauuacguucaagcccccaacggcgaauuuaccgugucuccucggaauagccccggggagauccuucugaaccucgaacugggaccugagcuuaauccguuccugucccaccucucucgcauguauaacggcuacgcgggcgggauugaugugcaggucaucauggccggaaaugcuuuuacagccggcaaaaucauuuucgcugccauucccccucauuuucccguggagaaccugagcccuccccagaucaccauguucccgcacaucauuguugacgugagaacacuggaaccuaucaauauucccgucccugaugugcggaacaacuuuuuccauuauaaucagaacaaugagucccgcaugagacucguugcgaugcuguacacaccccuucggucuaacgggagcgccgaagacguguuuaccgucuccugccgcgugcugaccaagcccagcgcugauuucgaguuuaauuaucucgugccuccgacggucgagucuagaaccaaacccuucacaaucccuauccugaccauuggagaaaugacaaacucccgguuucccguuccuaucgacaugcuucacaccagccccacggagaauauuguggugcaaccgcagaacggccgcuguacaaucgauggggaacugcucggaaccacacagcugauuaccucuaauaucugcuccuucagaggcagcaucucuggccaugaggggaacgacgaucagcaccuguggcacuucaauauuaccaacccuaauggaacacccuuugacccuacggaagauguccccgccccucucggcacccccgacuuccgggggcaacuguacggagugaucucccagcgcgacagagagggcacaccgagcgagaacaaucagaaggcuaaccggucccaucaggggguuauuucuaccaucagcccuaaauuugugcccaaacuuggauccgucaugauuggcacauggaccacggaugacaucaagaaucaacccagcaaguucacaccuaucggccugaacgaugacgauaacuuuaagcagugggaacucccgaauuauucuggggcccugacccuuaacaugggacuggcccccuccguguucccuaccuaccccggcgagcagauucucuuuuuccgcagcuaccugccucugaaagggggauauggcucucccuuuaucgacugucucguuccucaagaauggguggcucacuucuaccaggagagcgcgcccgcccagacagaugucgcucugauuagauaugugaauccggaaaccgggcggguccuuuuugaggccaagcugcauagacagggcuucaucacaguggccaaauccggagacucuccuauuaacguucccgcuaauggcuacuuucgcuucgauagcugggugaaccaauucuauucccucgccccuauggggacgggaaauggccggagacgcauccaguga

SEQ ID NO: 27488 - RNA, 1617 nt, Artificial Sequence
  derived and/or modified sequence opt5 from VP1__Norovirus__ALT06546
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauaauaaccagcccaacagccgcaugagacuugucgcuaugcuguacacaccccuccgguccaauggcucuggggacgauguguucaccgugagcugccgcguccugacgagaccuaccccggacuuugaguucacauaucugguucccccuuccguggaaagcaagaccaaacccuuuucucucccuauucugacacuuuccgagcugaccaacagccgguuccccgugccgaucgauucucucuuuacggcccaaaauaacguccuucaggugcagugucagaauggacgcugcacacuugacggcgagcugcaagggaccacacagcuccugccuuccggaauuugugcuuucagaggccggguuaccgccgaaaccgaucaucgcgacaaguggcacaugcagcugcagaaccucaauggcacaacguacgaucccaccgacgacgugccugcuccccuggggacaccugauuucaaaggagucguguuuggcauggccagccaaagaaacguugggaaugacgcgcccggaucuacccgggcccaugaggcugugaucuccacauauagcccgcaguucgucccuaagcugggcuccgugaacuuucgcucuaaugauaacgacuuccagcugcaacccaccaaguuuacgcccgucgggauuaaugaugacggagaucacccuuucagacagugggaacucccggacuacagcggcccccugacacuuaacaugaaucuggccccucccguggccccuaacuuucccggcgagcagcuccuguucuuucgguccuucguuccuugcagcgggggauacaaccagggcaucguggauugucugaucccccaagaauggauucagcacuuuuaucaggagucugcuccgucccagagcgacgucgcccucaucagauacgugaauccugauaccgggcgcacccuguucgaggcgaaacuucaucggucuggauauauuacaguugcucacagcggcgacuacccccugguggucccugccaacggguauuuuagauucgacuccugggugaaucaauucuacucucucgcccccaugggcaccggaaacggccgccggagagcucaguga

SEQ ID NO: 27489 - RNA, 1647 nt, Artificial Sequence
  derived and/or modified sequence opt5 from VP1__Norovirus__BAG30939
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgcccgccagauuacaaugugcccucaugugaucgucgaugugagacaacuggagcccguuaaccucccgaugccugacgugcggaauaacuucuuucacuauaaccagggcucugauagccgccugagacuuauugcuaugcuguacacaccccuccgggccaauaacuccggggacgaugucuucaccgugucuugucgcgugcugaccagaccuagccccgacuuuuccuucaauuuucuuguucccccuacagucgaaagcaagaccaaaccguucacgcugcccauccucaccauuucugagauguccaacagccgguuuccugugcccaucgauucucugcauacauccccuaccgaaaauaucgugguccagugccagaacggacgcgugacacuggacggcgagcucauggggaccacgcaacugcuucccagccagauuugugccuucaugggaguucugacaagaucuaccucccgggcuagcgaucaggcggacacagccaccccgcgccucuucaauuauuacuggcacauccagcuggacaacccuaauggcacccccuaugauccugcugaggacauucccggcccucuugggacacccgauuuuagaggaaagguguucggcgucgccucccaacggaacccggacucuacgacccgcgcccaugaagcuaaaguggauacaaccgccgggagauuuacaccuaagcugggaagccucgagaucuccaccgaaagcgacgauuuccaccagaaucagcccacgcgguuuacacccguuggcauugggguggacaacgaggcggauuuccaacaguggucucugccugacuacuccggacaguuuacccacaauaugaaccuggcuccggccgucgcccccaauuucccuggcgaacagcuccuguuuuucagaagccaacuucccucuagcggcgggcgcuccaacggaauccuggauugccucgugccucaggaguggguccagcauuuuuaccaggagucugcucccagccaaacccagguggcccugguucgguaugugaacccugacacaggcagaguccuuuucgaagcuaagcugcacaaacucggguuuaugaccaucgccaagaauggagacucccccauuacagugccgccuaacggcuacuuccgcuucgagagcuggguuaaucccuuuuauacgcuggcgccuauggggaccggcaacggacggagacgcauccaguga

SEQ ID NO: 27490 - RNA, 1623 nt, Artificial Sequence; identical to SEQ ID NO: 26932
  derived and/or modified sequence opt5 from VP1__Norovirus__BAG70428

SEQ ID NO: 27491 - RNA, 1623 nt, Artificial Sequence; identical to SEQ ID NO: 26932
  derived and/or modified sequence opt5 from VP1__Norovirus__BAG70431

SEQ ID NO: 27492 - RNA, 1623 nt, Artificial Sequence
  derived and/or modified sequence opt5 from VP1__Norovirus__BAG70434
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaaugcccacaacguucaucuugcuccggccguggcgcccaccuuuccuggggagcagcuccuguucuuucggucuacaaugcccggauguuccggcuauccuaauauggaucuggacugccugcucccccaggaguggguccagcacuucuaccaagaagcugccccugcccagagcgauguggcucugcuucgcuuugugaaccccgacaccgggagaguucuguucgaguguaaacuccauaagucuggauaugucacaguggcccacaccggccagcacgaucuggugaucccgccuaacggguacuuucgguucgacagcugggucaaucaguucuauacgcuugcucccaugggcaacggaaccggcagacgccgggcccuguga

SEQ ID NO: 27493 - RNA, 1623 nt, Artificial Sequence
  derived and/or modified sequence opt5 from VP1__Norovirus__BAG70437
augaagauggccagcaacgacgcuaaucccuccgauggcucuaccgccaaccuggugccugaggucaauaacgaaguuauggcgcucgagccgguggugggggcugccaucgccgcucccgucgccggacagacaaaugugauugacccuuggaucagaaacaauuucguucaagcucccggcggggaauuuacggugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuaccgccgggaaaauuaucuucgcgaagguuccucccaacuuuccuacagagggacugagccccucccaggugaccauguucccgcauaucauugucgacgugagacagcucgagccugugcugaucccccugccugauguccggaauaacuuuuaucacuacaaucaaucuaacgacagcacaauuaaacucaucgccaugcuguauacaccccuucgcgcuaacaaugccggcgaagauguuuucaccguguccugcagagugcugacccggcccagcccugacuuugauuucauuuuucucgucccgcccacgguggagucucgcaccaagccuuucacaguucccauccugaccguggaagagaugacaaacuccagauuuccuauuccccuugagaaacuguucaccgggccgagcggagcuuucgucgugcagccucagaauggccgguguacgacagacgggguucuccugggaaccacacagcugucucccgugaacaucugcaccuuucgcggcgaugucacccauaucgccggcuccagaaauuacacaaugaaccucgccagccugaauuggaacaauuaugacccuacggaagagauucccgcuccucuugggacccccgauuucgugggaaagauccaaggcguccugacacagaccacaaagggggacggaucuacccggggccacaaagcgacgguguacacaggguccgccccguuuaccccuaagcucggaagcguucaguucuccaccgacacagaaaacgauuuugagacccaucagaauacaaaauucacgcccgugggcgucauucaagacggcucuaccacacaccgcaacgaaccccagcagugggugcugccuagcuacuccgggagaaauguucacaacgugcaucuugcuccggccgucgcccccaccuuuccuggagagcaacuccuguucuuucggagcacaaugcccggcuguucuggguauccuaauauggaucuggacugccugcucccccaggagugggugcagcacuucuaccaggaagcugccccugcgcaauccgauguggcucugcuucgcuuuguuaaccccgacaccggaagaguccuguucgaguguaagcuccauaaaagcggcuaugugacgguggcccacaccgggcagcacgaucuggucaucccgccuaacggcuacuuucgguucgacucuugggugaaucaguucuauacacuugcccccaugggaaacggcaccgggagacgccgggcucuguga

SEQ ID NO: 27494 - RNA, 1623 nt, Artificial Sequence
  derived and/or modified sequence opt5 from VP1__Norovirus__BAG70440
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcucugccuucgucgugcagccucagaauggacgguguaccacggauggcguucuccuggggacaacccaacugucccccgugaacaucugcacauuucgcggagacgucacccauaucgccggcagcagaaauuacaccaugaaccucgcuucucugaauuggaacaauuaugauccuacagaggaaauucccgcgccucuuggcacgcccgacuucguggggaaaauccagggaguccugacccagacaaccaagggcgacggguccacacggggacacaaggccaccguguacacgggcagcgcuccguuuacaccuaaacucggguccguucaguucucuaccgauaccgagaacgacuuugaaacacaucaaaauaccaaguucacacccgugggagucauucaggauggcggcacgacccaccgcaacgagccccagcaaugggugcugccuagcuacuccgggagaaauguucacaacgugcaucuugccccggccgucgcucccacauuuccuggagaacagcuccuguucuuucggagcaccaugcccggcuguucuggguauccuaauauggaccuggauugccugcucccccaggagugggugcagcacuucuaccaagaggccgcgccugcucaguccgacguggcccugcuucgcuuuguuaaccccgauacaggaagaguccuguucgaauguaaacuccauaagagcggcuaugugaccguggccuacacggggcagcacgaccuggucaucccgccuaacggcuauuuucgguucgauucuugggugaaucaguucuacacccuugcucccaugggaaacggcacagggagacgccgggcccuguga

SEQ ID NO: 27495 - RNA, 1623 nt, Artificial Sequence
  derived and/or modified sequence opt5 from VP1__Norovirus__BAG70446
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaagcacgacccaccagaacgagccccagcaguggguucucccuaauuacucuggccgcgacucccacaacgugcaucuggcuccggccgucgcccccagcuuuccuggcgaacaacuucuguucuuuagaucuacaaugcccggguguagcggauacccuaauaugaaccucgauugccugcugccccaggagugggugcagcacuucuaucaggaggcugccccugcgcaauccgacguggcucuccugcgguuuguuaaucccgauaccggcagaguccuuuucgaauguaaacugcauaagucuggguacgugacaguggcccacaccggacagcacgaccucgucaucccgccuaacggcuauuuucgcuucgauagcugggugaaccaguucuacacgcuggcccccauggggaauggcaccggacggagacgcgcucuuuga

SEQ ID NO: 27496 - RNA, 1623 nt, Artificial Sequence
  derived and/or modified sequence opt5 from VP1__Norovirus__BAG70449
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacagcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgaccccacaauuaagcucaucgccaugcuguauacaccccuucgcgcuaacaaugccggagaagauguuuucaccguguccugcagagugcugacccggccuagcccggacuuugauuucauuuuucucgugcccccuacagucgagucucgcaccaaacccuucacgguuccuauccugaccguggaagagaugacaaacuccagauuucccauuccgcuugagaagcuguucaccggcccuagcggggccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaguccugacgcagaccacaaagggcgacgggucuacccggggacacaaggccacaguguacaccggcuccgccccuuuuacgcccaaacucgggagcguucaguucuccacagacaccgaaaacgauuuugagacccaucaaaauacaaaguucacccccgugggagucauucaggacggcucuacaacgcaccgcaacgaaccucagcaaugggugcugccgagcuacuccggcagaaauguucacaacgugcaucuugcccccgcugucgccccuaccuuucccggggagcagcuccuguucuuucggagcacaaugccuggauguucuggcuaucccaauauggaucuggacugccugcucccucaggagugggugcagcacuucuaccaagaagcggcucccgcccaguccgauguggcccugcuucgcuuuguuaacccggacaccgggagaguccuguucgaguguaaacuccauaagagcggauaugugacaguggcucacaccggccagcacgaucuggucaucccucccaacggguacuuucgguucgacucuugggugaaucaguucuauacgcuugccccuaugggcaacggaaccggcagacgccgggcucuguga

SEQ ID NO: 27497 - RNA, 1623 nt, Artificial Sequence
  derived and/or modified sequence opt5 from VP1__Norovirus__BAG70452
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaacucaacgacucuaccauuaagcugaucgccaugcuuuauacaccccugcgcgcuaacaaugccggcgaagauguuuucaccgugagcugcagagugcucacacggcccuccccugacuuugauuucauuuuucuggucccgcccaccguggagagccgcacgaaaccuuucaccguucccauccuuacaguggaagagaugaccaacucuagauuuccuauuccccuggagaaacucuucacagggccguccggagccuucgucgugcagccucagaauggccgguguaccacggacgggguucugcugggaacaacccagcucagccccgugaacaucugcacauuucgcggcgaugucacccauaucgcuggcucuagaaauuacaccaugaaccuggcgucccuuaauuggaacaauuaugacccuacagaagagauucccgccccucuggggacgcccgauuucgugggaaagauccaaggcguccucacccagacaaccaagggggacggaagcacacggggccacaaggcuaccguguacacggggucugccccguuuacaccuaaacugggauccguucaguucagcaccgacaccgaaaacgauuuugagacacaucagaauaccaaguucacacccgugggcgucauucaagacggcuccacgacccaccgcaacgaaccccagcagugggugcuuccuucuuacagcgggagaaauguucacaacgugcaucuggccccggcugucgcccccacauuuccuggagagcaacuccuguucuuucgguccaccaugcccggcuguagcggguauccuaauauggaucuggacugccuccugccccaggagugggugcagcacuucuaccaggaagcggcuccugcccaaucugauguggcccuucugcgcuuuguuaaccccgacacaggaagaguccucuucgaguguaaacugcauaaguccggcuaugugaccguggcucacacggggcagcacgaucuugucaucccgccuaacggcuacuuucgguucgacagcugggugaaucaguucuauacccuggcccccaugggaaacggcacagggagacgccgggcucucuga

SEQ ID NO: 27498 - RNA, 1623 nt, Artificial Sequence; identical to SEQ ID NO: 26802
  derived and/or modified sequence opt5 from VP1__Norovirus__BAG70458

SEQ ID NO: 27499 - RNA, 1623 nt, Artificial Sequence; identical to SEQ ID NO: 26480
  derived and/or modified sequence opt5 from VP1__Norovirus__BAG70461

SEQ ID NO: 27500 - RNA, 1623 nt, Artificial Sequence; identical to SEQ ID NO: 26480
  derived and/or modified sequence opt5 from VP1__Norovirus__BAG70464

SEQ ID NO: 27501 - RNA, 1623 nt, Artificial Sequence; identical to SEQ ID NO: 26480
  derived and/or modified sequence opt5 from VP1__Norovirus__BAG70467

SEQ ID NO: 27502 - RNA, 1623 nt, Artificial Sequence; identical to SEQ ID NO: 26932
  derived and/or modified sequence opt5 from VP1__Norovirus__BAG70470

SEQ ID NO: 27503 - RNA, 1623 nt, Artificial Sequence; identical to SEQ ID NO: 26932
  derived and/or modified sequence opt5 from VP1__Norovirus__BAG70473

SEQ ID NO: 27504 - RNA, 1623 nt, Artificial Sequence
  derived and/or modified sequence opt5 from VP1__Norovirus__BAG70476
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaggaacuucccgccccucuggggacacccgauuucgugggaaaaauucagggcguccucacgcagaccacaaagggggacggaucuacccggggccacaaggcuacaguguacaccggguccgccccguuuacgccuaaacugggaagcguucaguucuccacagacaccgaaaacgauuuugagacccaucaaaauacaaaguucacccccgugggcgucauccaggacggcucuacaacgcaccgcaacgaaccccagcaaugggugcuuccuagcuacuccgggagaaauguucacaacgugcaucuggccccggcugucgcccccaccuuuccuggagagcagcuccuguucuuucggagcacaaugcccggcuguucuggguauccuaauauggaucuggacugccuccugccccaggagugggugcagcacuucuaccaagaagcggcuccugcccaguccgauguggcccuucugcgcuuuguuaaccccgacaccggaagaguccucuucgaguguaaacugcauaagagcggcuaugugacaguggcucacaccgggcagcacgaucuugucauuccgccuaacggcuacuuucgguucgacucuugggugaaucaguucuauacgcuggcccccaugggaaacggcaccgggagacgccgggcucucuga

SEQ ID NO: 27505 - RNA, 1623 nt, Artificial Sequence
  derived and/or modified sequence opt5 from VP1__Norovirus__BAG70482
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggacggacugagccccucccaggugaccauguucccgcauaucauugucgaugugagacaacucgagccugugcugaucccccugccugacguccggaauaacuuuuaucacuacaaucagucuaacgauagcacaauuaagcucaucgccaugcuguauacaccccuucgcgcuaacaaugccggcgaggacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgagaacgacuuugaaacccaucaaaauacaaaguucacccccgugggagucauucaggauggcggcacaacgcaccgcaacgagccccagcaaugggugcugccuagcuacuccgggagaaauguucacaacgugcaucuugccccggcugucgcccccaccuuuccuggagaacagcuccuguucuuucggagcacaaugcccggcuguucuggguauccuaauauggaccuggauugccugcucccccaggagugggugcagcacuucuaccaagaggcggcuccugcccaguccgacguggcccugcuucgcuuuguuaaccccgauaccggaagaguccuguucgaauguaaacuccauaagagcggcuaugugacaguggcucacaccgggcagcacgaccuggucaucccgccuaacggcuacuuucgguucgauucuugggugaaucaguucuauacgcuugcccccaugggaaacggcaccgggagacgccgggcucuguga

SEQ ID NO: 27506 - RNA, 1623 nt, Artificial Sequence; identical to SEQ ID NO: 26480
  derived and/or modified sequence opt5 from VP1__Norovirus__BAG70485

SEQ ID NO: 27507 - RNA, 1623 nt, Artificial Sequence; identical to SEQ ID NO: 26480
  derived and/or modified sequence opt5 from VP1__Norovirus__BAG70488

SEQ ID NO: 27508 - RNA, 1623 nt, Artificial Sequence
  derived and/or modified sequence opt5 from VP1__Norovirus__BAG70491
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccacccaucggaacgaaccccaacagugggugcucccugacuacagcgggcgcacagcucacaauguucaccuggccccggccguggcucccaccuuuccuggagagcagcuucuguucuuuagaucuacaaugcccggcuguuccggguacccuaacauggaucucgacugccugcugccccaggaauggguccaacauuucuaucaggaggccgcgccuagccagucugauguggcucuccugcgguuugugaaucccgacaccggaagaguucuuuucgaguguaagcugcacaaagccggcuacgucacgguggcccauaccgggcagcacgaucucgugaucccgccuaacggcuauuuucgcuucgacagcugggucaaucaauucuacacacuggcucccaugggaaacggcgccgggcggagacgcgcucuuuga

SEQ ID NO: 27509 - RNA, 1623 nt, Artificial Sequence
  derived and/or modified sequence opt5 from VP1__Norovirus__BAG70494
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccgccccguuuacgccuaaacucggaagcguucaguucuccacagauaccgaaaaugacuuugagacccaucaaaacacaaaguucacccccgugggcgucauucaggauggcucuacaacgcaccgcaaugaaccccagcaaugggugcugccuagcuacuccgggagaaacguucacaaugugcaucuugccccggcugucgcccccaccuuuccuggagagcagcuccuguucuuucggagcacaaugcccggcuguucuggguauccuaacauggaccuggauugccugcucccccaggagugggugcagcacuucuaccaagaagcggcuccugcccaguccgacguggcccugcuucgcuuuguuaaucccgauaccggaagaguccuguucgaguguaaacuccauaagagcggcuaugugacaguggcucacaccgggcagcacgaccuggucaucccgccuaacggcuacuuucgguucgauucuugggugaaccauuucuauacgcuugcccccaugggaaauggcaccgggagacgccgggcucuguga

SEQ ID NO: 27510 - RNA, 1623 nt, Artificial Sequence; identical to SEQ ID NO: 26802
  derived and/or modified sequence opt5 from VP1__Norovirus__BAG70497

SEQ ID NO: 27511 - RNA, 1623 nt, Artificial Sequence; identical to SEQ ID NO: 26972
  derived and/or modified sequence opt5 from VP1__Norovirus__BAG70503

SEQ ID NO: 27512 - RNA, 1623 nt, Artificial Sequence; identical to SEQ ID NO: 26802
  derived and/or modified sequence opt5 from VP1__Norovirus__BAG70506

SEQ ID NO: 27513 - RNA, 1623 nt, Artificial Sequence
  derived and/or modified sequence opt5 from VP1__Norovirus__BAG70509
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcaccagaaauuacaccaugaaccucgcgucccugaauuggaacaauuaugacccuacagaagagauucccgccccucuugggacgcccgauuucgugggaaaaauccagggcguccugacccagacaaccaagggggacggaagcacacggggccacaaggcuaccguguacacggggucugccccguuuacaccuaaacucggauccguucaguucagcaccgacaccgaaaacgauuuugagacacaucaaaauaccaaguucacacccgugggcgucauucaggacggcgggacgacccaccgcaacgaaccccagcaaugggugcugccuuccuacucuggaagaaauguucacaacgugcaucuugccccggcugucgcccccacauuuccuggcgagcagcuccuguucuuucggagcaccaugcccggguguuccggauauccuaauaugaaccuggauugccugcucccccaggagugggugcagcacuucuaccaagaagcggcuccugcccagagcgacguggcccugcuucgcuuuguuaaccccgauacaggcagaguccuguucgaguguaaacuccauaagucuggguaugugaccguggcucacacgggccagcacgaccuggucaucccgccuaauggauacuuucgguucgauuccugggugaaccaguucuauacccuugcccccaugggcaaugggacaggaagacgccgggcucuguga

SEQ ID NO: 27514 - RNA, 1623 nt, Artificial Sequence
  derived and/or modified sequence opt5 from VP1__Norovirus__BAG70512
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcaccagaaauuacaccaugaaccucgcgucccugagcuggaauaacuaugacccuacagaagagauucccgccccucuugggacgcccgauuucgugggaaaaauccagggcguccugacccagacaaccaagggggacggaucuacacggggccacaaggcuaccguguacacgggguccgccccguuuacaccuaaacucggaagcguucaguucuccaccgacaccgaaaaugauuuugagacacaucaaaacaccaaguucacacccgugggcgucauucaggacggcgggacgacccaccgcaaugaaccccagcaaugggugcugccuucuuacagcggaagaaacguucacaaugugcaucuugccccggcugucgcccccacauuuccuggcgagcagcuccuguucuuucgguccaccaugcccggguguagcggauauccuaacauggaucuggacugccugcucccccaggagugggugcagcacuucuaccaagaagcggcuccugcccagucugauguggcccugaugcgcuuuguuaaucccgacacaggcagaguccuuuucgaguguaaacugcauaaguccggguaugugaccguggcucacacgggccagcacgaucucgucaucccgccuaacggauacuuucgguucgacagcugggugaaccaguucuauacccuggcccccaugggcaaugggacaggaagacgccgggcucuuuga

SEQ ID NO: 27515 - RNA, 1623 nt, Artificial Sequence
  derived and/or modified sequence opt5 from VP1__Norovirus__BAG70515
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggccugcucacgcagaccacaaagggggacggaucuacccggggccacaaggcuacagucuacaccggguccgccccguuuacgccuaaacugggaagcgugcaguucuccacagacaccgaaaacgauuuugagacccaucaaaauacaaaguucacccccguuggcgugauucaggacggcucuacaacgcaccgcaacgaaccccagcaauggguccuuccuagcuacuccgggagaaaugugcacaacguucaucuggccccggcuguggcccccaccuuuccuggagagcagcuccuguucuuucggagcacaaugcccggcuguucuggguauccuaauauggaucuggacugccuccugccccaggaguggguccagcacuucuaccaagaagcggcuccugcccaguccgauguggcccuucugcgcuuugugaaccccgacaccggaagaguucucuucgaguguaaacugcauaagagcggcuaugucacaguggcucacaccgggcagcacgaucuugugaucccgccuaacggcuacuuucgguucgacucuugggucaaucaguucuauacgcuggcccccaugggaaacggcaccgggagacgccgggcucucuga

SEQ ID NO: 27516 - RNA, 1623 nt, Artificial Sequence; identical to SEQ ID NO: 27515
  derived and/or modified sequence opt5 from VP1__Norovirus__BAG70518

SEQ ID NO: 27517 - RNA, 1623 nt, Artificial Sequence
  derived and/or modified sequence opt5 from VP1__Norovirus__BAG70521
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccggcccuuccagcgccuucgugguucagccccagaacgggcgguguacaaccgauggagugcuccugggcacgacacaacugucuccugucaauauuugcaccuuucgcggggacgugacacauaucgccggaacccaggaguacaccaugaaccucgcuucccagaauuggaacaauuaugaucccacagaagagaucccugcgccccugggcacgccggacuucgucggcaaaauucagggggugcuuacccaaacaaccagacgggacggaagcacacgcggccacaaggccaccguuuccacggggucugugcauuuuacaccuaagcugggaagaauccaguucagcaccgauaccuccaacgacuuugaaacaggccagaauacccgguucacacccgucggggugguucaagauggaggcacgacccaccagaacgagccccagcagugggugcucccuaauuacagcggccgcgacucucacaacguccaucuggcuccggccguggcccccuccuuuccuggggaacaacuucuguucuuuagaagcacaaugcccggauguucuggcuacccuaauaugaaccucgauugccugcugccccaggagugggugcagcacuucuaucaggaggcugccccugcgcaaagcgacguugcucuccugcgguuugucaaucccgauaccgggagagugcuuuucgaauguaaacugcauaaguccggauacgugacagucgcccacaccggccagcacgaccucgugauuccgccuaacggguauuuucgcuucgauucuuggguuaaccaguucuacacgcuggcccccaugggcaauggaaccggccggagacgcgcucuuuga

SEQ ID NO: 27518 - RNA, 1623 nt, Artificial Sequence
  derived and/or modified sequence opt5 from VP1__Norovirus__BAG70524
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggccugcucacgcagaccacaaagggggacggaucuacccggggccacaaggcuacagucuacaccggguccgccccguuuacgccuaaacugggaagcgugcaguucuccacagacaccgaaaacgauuuugagacccaucaaaauacaaaguucacccccguuggcgugauucaggacggcucuacaacgcaccgcaacgaaccccagcaauggguccuuccuagcuacuccgggagaaaugugcacaacguucaucuggccccggcuguggcccccaccuuuccuggagagcagcucaucuucuuucggagcacaaugcccggcuguucuggguauccuaauauggaucuggacugccugcucccccaggaguggguccagcacuucuaccaagaagcggcuccugcccaguccgauguggcccugcuucgcuuugugaaccccgacaccggaagaguucuguucgaguguaaacuccauaagagcggcuaugucacaguggcucacaccgggcagcacgaucuggugauuccgccuaacggcuacuuucgguucgacucuugggucaaucaguucuauacgcuugcccccaugggaaacggcaccgggagacgccgggcucuguga

SEQ ID NO: 27519 - RNA, 1623 nt, Artificial Sequence
  derived and/or modified sequence opt5 from VP1__Norovirus__BAG70527
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacucuuaugacccuaccgaagagauucccgccccucuugggacacccgauuucgugggaaaaauccagggccugcucacgcagaccacaaagggggacggauccacccggggccacaaggcuacagucuacaccgggagcgccccguuuacgccuaaacugggauccgugcaguucucuacagacaccgaaaaugauuuugagacccaucaaaacacaaaguucacccccguuggcgugauucaggacggcagcacaacgcaccgcaaugaaccccagcaauggguccuuccuuccuacagcgggagaaacgugcacaauguucaucuggccccggcuguggcccccaccuuuccuggagagcagcuccuguucuuucggucuacaaugcccggcuguuccggguauccuaacauggaucuggacugccuccugccccaggaguggguccagcacuucuaccaagaagcggcuccugcccagagcgauguggcccuucugcgcuuugugaaucccgacaccggaagaguucucuucgaguguaaacugcauaagucuggcuaugucacaguggcucacaccgggcagcacgaucuugugaucccgccuaacggcuacuuucgguucgacagcugggucaaccaguucuauacgcuggcccccaugggaaauggcaccgggagacgccgggcucucuga

SEQ ID NO: 27520 - RNA, 1623 nt, Artificial Sequence; identical to SEQ ID NO: 27515
  derived and/or modified sequence opt5 from VP1__Norovirus__BAG70530

SEQ ID NO: 27521 - RNA, 1623 nt, Artificial Sequence; identical to SEQ ID NO: 27515
  derived and/or modified sequence opt5 from VP1__Norovirus__BAG70533

SEQ ID NO: 27522 - RNA, 1623 nt, Artificial Sequence; identical to SEQ ID NO: 27515
  derived and/or modified sequence opt5 from VP1__Norovirus__BAG70536

SEQ ID NO: 27523 - RNA, 1623 nt, Artificial Sequence; identical to SEQ ID NO: 27081
  derived and/or modified sequence opt5 from VP1__Norovirus__BAI70518

SEQ ID NO: 27524 - RNA, 1623 nt, Artificial Sequence
  derived and/or modified sequence opt5 from VP1__Norovirus__BAJ13508
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacauggcccugcuuagauuugucaacccugauaccggacgcgugcuguucgaguguaaacuccacaaguccggcuacgugacaguugcucauaccgggcagcacgaccuggucauucccccgaacggcuauuuucgguucgauagcugggugaaucaauuuuacacgcuugccccuaugggaaacggcaccgggagacgccgggcgguguga

SEQ ID NO: 27525 - RNA, 1623 nt, Artificial Sequence
  derived and/or modified sequence opt5 from VP1__Norovirus__BAJ13513
augaagauggccagcuccgacgcuaaucccccugauggcucugccgcgaaccuggugccggaggucaacaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucugugguccgccccgcuuggccccgaucugaacccuuaccucucucaccuggcucgcauguauaauggguacgccggaggcuucgaaguccaggugauccuugcuggcaacgccuuuacagcggggaaaauuaucuucgccgcuguucccccuaauuuucccacggagggacugagcccgucccaggugaccauguucccucauaucauugucgacgugagacaacucgagcccgugcugaucccucugcccgauguccggaacaauuuuuaucacuacaaccagucuaaugacagcacaauuaagcucaucgccaugcuguauacaccccuucgcgcuaacaacgccggcgaagauguuuucaccguguccugcagagugcugacccggccuagcccggacuuugauuucauuuuucucgugcccccuacagucgagucucgcaccaaacccuucacgguuccuauccugaccguggaagagaugacaaauuccagauuucccauuccgcuugagaagcuguucaccgggccuagcggagccuucgucgugcagccccagaacggccgguguacaaccgacgggguucuccugggaacgacacaacugucuccugugaauaucugcaccuuucgcggcgaugcuacacauaucgcgggcuccagaagcuacaccaugaaccucgccucucugaauuggaacaauuaugaccccaccgaagagauuccugcuccccuugggacaccggauuucgucggaaaaauccagggcaugcugacgcagaccacaaagggggacggauccacccggggccacaaggccacaguguacaccgggagcgccccuuuuacgcccaaacucggauccguccaguucucuacagacaccgaaaacgauuuucaaacccaucagaauacaaaguucacccccgugggcguuauucaggacggcagcacaacgcaccgcaacgagccucaacagugggugcugccguccuacagcgggagagauguccacaaugugcaucuugcucccgccguugcgccuaccuuucccggagaacagcuccuguucuuucggucuacaaugccuggcuguuccggguaucccaacauggaccuggauugccugcucccucaggagugggugcaacacuucuaccaggaggcugcccccgcccagagcgacgucgcucugcuucgcuuugugaauccggauaccggaagagugcuguucgaauguaaacuccauaagucuggcuauguuacagucgcccacaccgggcagcacgaccuggugaucccucccaacggcuacuuucgguucgauagcugggugaaucaauucuauacgcuugcuccuaugggaaacggcaccgggagacgccgggcccuguga

SEQ ID NO: 27526 - RNA, 1623 nt, Artificial Sequence
  derived and/or modified sequence opt5 from VP1__Norovirus__BAJ13520
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcaugcugacgcagaccacaaagggggacggauccacccggggccacaaggcuacagucuacaccgggagcgccccguuuacgccuaaacucggaaaugugcaguucuccacagacaccgaaaacgauuuugagacccaucaaaauacaaaguucacccccguuggcgugauucaggacggcucuacaacgcaccgcaacgaaccccagcaauggguccugccuagcuacuccgggagagaugugcacaauguucaucuugccccggcuguggcccccaccuuuccuggagagcagcuccuguucuuucggagcacaaugcccggcuguucuggguauccuaacauggaccuggauugccugcucccccaggaguggguccagcacuucuaccaagaagcggcuccugcccaguccgacguggcccugcuucgcuuugugaaucccgauaccggaagaguucuguucgaguguaaacuccauaagagcggcuaugucacaguggcucacaccgggcagcacgaccuggugaucccgccuaacggcuacuuucgguucgauucuugggucaaccaguucuauacgcuugcccccaugggaaauggcaccgggagacgccgggcucuguga

SEQ ID NO: 27527 - RNA, 1623 nt, Artificial Sequence
  derived and/or modified sequence opt5 from VP1__Norovirus__BAJ13534
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuagcgacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgggcucuguga

SEQ ID NO: 27528 - RNA, 1623 nt, Artificial Sequence
  derived and/or modified sequence opt5 from VP1__Norovirus__BAJ13537
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccacacagaacuggaacuccuaugaucccacggaggaaaucccugcuccccugggcaccccggacuucgucgggaaaauucagggagugcuuacacagaccacacgggcggacggcagcacccgcgggcacaaggccacgguuuacacaggauccgcugauuuugccccuaagcugggcagagugcaauucgccaccgacaccgauaaugacuuugaugcuaaucagaacacaaaauucacccccgucggggugauccaggacggagauacagcccaucggaaugagccccaacaguggguucucccuucuuacagcggccgcaacaaucacaacgugcaccuggcgccggcugucgcccccacguuuccuggcgaacagcuucuguucuuuagauccaccaugcccggguguagcggauauccuaauauggaccucgauugccugcugccccaggagugggugcaauacuucuaucaggaagccgcuccugcccagucugacguggcucuccugcgguuuguuaaccccgauacaggcagaguccuuuucgaguguaagcugcauaaauccggguacgugaccguggcccacacaggacagcaugaccucgucauuccgccuaacggcuauuuucgcuucgacagcugggugaaucaauucuacacccuggcgcccauggggaacggcacgggacggagacgcgcccuuuga

SEQ ID NO: 27529 - RNA, 1623 nt, Artificial Sequence
  derived and/or modified sequence opt5 from VP1__Norovirus__BAJ13540
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgugggcuccagaaauuacaccaugaaccucgcuagccugaauuggaacaauuaugacccuacagaagagauucccgcgccucuugggacgcccgauuucgucggaaaaauccaaggcgugcugacccagacaaccaagggggacggaucuacacggggccacaaggccaccguuuacacgggguccgcuccguuuacaccuaaacucggaagcgugcaguucuccaccgacaccgaaaacgauuuugaggcccaucagaauacaaaguucacccccgucggcgugauucaagacggcucuacaacgcaccgcaacgaaccccagcaguggguucugccuagcuacuccgggagaaaugugcaaaacguccaccuugccccggcuguggcccccaccuuuccuggagagcagcuccuguucuuucggagcacaaugcccggcuguucuggguauccuaauauggaucuggacugccugcucccccaggagugggugcagcauuucuaccaagaagcggcuccugcccaguccgauguugcccugcuucgcuuugucaaccccgacaccggaagagugcuguucgaguguaaacuccacaagagcggcuaugugacagucgcucauaccgggcagcacgaucuggugaucccgccuaacggcuacuuucgguucgacucuuggguuaaucaguucuauacgcuugcccccaugggaaacggcaccgggagacgccgggcucuguga

SEQ ID NO: 27530 - RNA, 1623 nt, Artificial Sequence; identical to SEQ ID NO: 27492
  derived and/or modified sequence opt5 from VP1__Norovirus__BAJ13543

SEQ ID NO: 27531 - RNA, 1623 nt, Artificial Sequence; identical to SEQ ID NO: 27492
  derived and/or modified sequence opt5 from VP1__Norovirus__BAJ13549

SEQ ID NO: 27532 - RNA, 1623 nt, Artificial Sequence
  derived and/or modified sequence opt5 from VP1__Norovirus__BAJ13552
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugaggcccaucagaauacaaaguucacccccgugggcgucauucaagacggcucuacaacgcaccgcaacgaaccccagcagugggugcugccuagcuacuccgggagaaauguucaaaacgugcaccuugcuccggccgucgcgcccaccuuuccuggagagcagcuccuguucuuucggagcacaaugcccggcuguucuggguauccuaauauggaucuggacugccugcucccccaggagugggugcagcauuucuaccaagaagcugccccugcccaguccgauguggcucugcuucgcuuuguuaaccccgacaccggaagaguccuguucgaguguaaacuccacaagagcggcuaugugacaguggcccauaccgggcagcacgaucuggucaucccgccuaacggcuacuuucgguucgacucuugggugaaucaguucuauacgcuugcucccaugggaaacggcaccgggagacgccgggcccuguga

SEQ ID NO: 27533 - RNA, 1623 nt, Artificial Sequence
  derived and/or modified sequence opt5 from VP1__Norovirus__BAJ13555
augaagauggccagcaacgaccccuccccuucugauggcagcgcugccaaucuggugccggaggucaacaaugaaguuauggcgcucgagcccguggugggggcugccaucgccgcuccugucgccggacagcaaaacgugauugaccccuggaucagaaauaacuucguucaggcuccuggcggggaauuuaccgugucuccccggaaugccccuggagagauucugugguccgcgccgcuuggccccgaucugaacccuuaccucagccaccuggcccgcauguauaauggguacgcuggaggcuucgaaguccaggugauccuugccggcaacgcuuuuacagccgggaaaauuaucuucgcggccguucccccuaauuuucccacggagggacuguccccgucucaggugaccauguucccucauaucauugucgacgugagacaacucgagcccgugcugaucccucugcccgauguccggaacaauuuuuaucacuacaaccagagcaaugacuccacaauuaagcucaucgcuaugcuguauacaccccuucgcgccaacaacgcuggcgaagauguuuucaccgugagcugcagagugcugacccggccuucuccggacuuugauuucauuuuucucgugcccccuacagucgagucccgcaccaaacccuucacgguuccuauccugaccguggaagagaugacaaauagcagauuucccauuccgcuugagaagcuguucaccgggccuucuuccgccuucgucgugcagccccagaacggacgguguacaaccgacggcguucuccuggggacgacacaacugagcccugugaauaucugcaccuuucgcggagaugucacacauaucgccggcucuagaaacuacaccaugaaucucgcuucccugaacuggaauaacuaugaccccaccgaagagauuccugcgccccuuggcacaccggauuucguggggaaaauccagggaguccugacgcagaccacaaagggcgacgggagcacccggggacacaaggccacaguguacaccggcuccgcuccuuuuacgcccaaacucgggucuguucaguucagcacagacaccgaaaaugauuuugagacccaucaaaacacaaaguucacccccgugggagucauucaggacggcggcacaacgcaccgcaaugaaccucagcaaugggugcugccguccuacagcgggagagauguucagaacgugcaccuugcccccgccgucgcuccuaccuuucccggagagcagcuccuguucuuucggucuacaaugccuggcuguuccggguaucccaauauggaccuggauugccugcucccucaggagugggugcaacauuucuaccaggaagccgcgcccgcucagagcgacguggcccugcuucgcuuuguuaacccggauaccggaagaguccuguucgaguguaaacuccacaagucuggcuaugugacaguggcccauaccgggcagcacgaccuggucaucccucccaauggcuacuuucgguucgauagcugggugaaccaauucuauacgcuugcuccuaugggaaacggcaccgggagacgccgggcccuguga

SEQ ID NO: 27534 - RNA, 1623 nt, Artificial Sequence; identical to SEQ ID NO: 27532
  derived and/or modified sequence opt5 from VP1__Norovirus__BAJ13558

SEQ ID NO: 27535 - RNA, 1623 nt, Artificial Sequence; identical to SEQ ID NO: 26802
  derived and/or modified sequence opt5 from VP1__Norovirus__BAJ13561

SEQ ID NO: 27536 - RNA, 1623 nt, Artificial Sequence
  derived and/or modified sequence opt5 from VP1__Norovirus__BAJ13564
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacauuaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauaccaaguucacacccgugggagucauccaggacggcagcaccacacaccgcaacgaaccccagcaaugggugcugccuuccuacagcggcagaaauguucacaacgugcaucuugccccggcugucgcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguggcccugcuucgcuuuguuaaccccgacacagggagaguccuguucgaguguaaacuccauaagucuggauaugugaccguggcucacacaggccagcacgaucuggucauuccgccuaacggguacuuucgguucgacagcugggugaaucaguucuauacccuugcccccaugggcaacggaacgggcagacgccgggcucuguga

SEQ ID NO: 27537 - RNA, 1623 nt, Artificial Sequence
  derived and/or modified sequence opt5 from VP1__Norovirus__BAJ13567
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucgcuucucuacagauaccgaaaaugacuuugagacccaucagaacacaaaguucacccccgugggagucauucaagauggcagcacaacgcacagaaaugaaccccagcagugggugcugccuuccuacagcggccgggacguucacaacgugcaucuugccccggcugucgcccccaccuuuccuggggagcaacuccuguucuuucgcucuacaaugcccggauguuccggcuauccuaauauggaucuggacugccugcucccccaggagugggugcagcacuucuaccaggaagcggcuccugcccaaagcgauguggcccugcuuagauuuguuaaccccgacaccgggcggguccuguucgaguguaaacuccauaagccgggauaugugacaguggcucacaccggccagcacgaucuggucaucccucccaauggguacuuuagauucgacucuugggugaaccaguucuauacgcuugccccuaugggcaacggaaccggccgccggagagcucuguga

SEQ ID NO: 27538 - RNA, 1623 nt, Artificial Sequence; identical to SEQ ID NO: 27532
  derived and/or modified sequence opt5 from VP1__Norovirus__BAJ13573

SEQ ID NO: 27539 - RNA, 1623 nt, Artificial Sequence
  derived and/or modified sequence opt5 from VP1__Norovirus__BAJ13576
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauuccuugguccgaaccgcugggccccgaucuuaauccuuaccugucucaccucgcccgcauguauaacggguacgcuggaggcuucgagguccaggugauccuggccggcaaugcuuuuacagccgggaaaauuaucuucgcggccguucccccuaacuuucccacggagggacuuagcccgucccaggugaccauguucccucauaucauugucgacgugagacaacuggaacccgugcucaucccucugcccgauguccggaauaacuuuuaucacuacaaucagucuaacgacagcacaauuaagcugaucgcuaugcucuauacaccccugcgcgccaacaaugcuggcgaggauguuuucaccguguccugcagagugcuuacccggccuagcccggacuuugauuucauuuuucuggugcccccuacagucgaaucucgcaccaaacccuucacgguuccuauccucaccguggaggagaugacaaacuccagauuucccauuccgcuggaaaaacuuuucaccgggccuagcucugccuucgucgugcagccccagaauggacgguguacaaccgacggcguucugcucgggacgacacaacuguccccugugaacaucugcaccuuucgcggagaugucacacauaucgccggcagcagaaauuacaccaugaaccuggcuucucucaauuggaacaauuaugaccccaccgaggaaauuccugcgccccugggcacaccggauuucguggggaagauccagggaguccuuacgcagaccacaaagggcgacggguccacccggggacacaaggccacaguguacaccggcagcgcugacuuuacgccuaaacugggguccguucaguucucuacagauaccgagaacgacuuugaaacccaucaaaauacaaaguucacccccgugggagucauucaggauggcggcacaacgcaccgcaacgagccccagcaaugggugcucccuagcuacuccgggagaaauguucacaacgugcaucuggccccggccgucgcucccaccuuuccuggagagcagcuucuguucuuucggagcacaaugcccggcuguucuggguauccuaauauggaccucgauugccugcugccccaggaaugggugcagcacuucuaccaagaggccgcgccugcucaguccgacguggcccuccugcgcuuuguuaaccccgauaccggaagaguccuuuucgaauguaaacugcauaagagcggcuaugugacaguggcccacaccgggcagcacgaccucgucaucccgccuaacggcuacuuucgguucgauucuugggugaaucaguucuauacgcuggcucccaugggaaacggcaccgggagacgccgggcccuuuga

SEQ ID NO: 27540 - RNA, 1623 nt, Artificial Sequence
  derived and/or modified sequence opt5 from VP1__Norovirus__BAJ13579
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccgacuuuacgccgaaacucggguccguucaguucucuacagauaccgaaaacgacuuugagacccaucaaaauacaaaguucaccccugugggagucauucaggauggcggcacaacgcaccgcaacgaaccccagcaaugggugcugcccagcuacuccgggagaaauguucacaacgugcaucuugccccugcugucgccccgaccuuucccggagagcagcuccuguucuuucggagcacaaugccuggcuguucuggguaucccaauauggaccuggauugccugcucccucaggagugggugcagcacuucuaccaagaagcggcucccgcccaguccgacguggcccugcuucgcuuuguuaacccugauaccggaagaguccuguucgaguguaaacuccauaagagcggcuaugugacaguggcucacaccgggcagcacgaccuggucauucccccgaacggcuacuuucgguucgauucuugggugaaucaguucuauacgcuugccccuaugggaaacggcaccgggagacgccgggcucuguga

SEQ ID NO: 27541 - RNA, 1623 nt, Artificial Sequence; identical to SEQ ID NO: 26932
  derived and/or modified sequence opt5 from VP1__Norovirus__BAJ13582

SEQ ID NO: 27542 - RNA, 1623 nt, Artificial Sequence; identical to SEQ ID NO: 27081
  derived and/or modified sequence opt5 from VP1__Norovirus__BAJ13585

SEQ ID NO: 27543 - RNA, 1623 nt, Artificial Sequence
  derived and/or modified sequence opt5 from VP1__Norovirus__BAJ13591
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacucuauaagagcggcuacgugacaguggcucacaccgggcagcaugaucuggucaucccucccaacggcuauuuucgguucgacucuugggugaaucaguucuacacgcuugccccuaugggaaacggcaccgggagacgccgggcucuguga

SEQ ID NO: 27544 - RNA, 1623 nt, Artificial Sequence
  derived and/or modified sequence opt5 from VP1__Norovirus__BAJ13594
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcaugcugacgcagaccacaaagggggacggauccacccggggccacaaggcuacagucuacaccgggagcgccccguuuacgccuaaacucggauccgugcaguucucuacagacaccgaaaaugauuuugagacccaucaaaacacaaaguucacccccguuggcgugauucaggacggcagcacaacgcaccgcaaugaaccccagcaauggguccugccuuccuacagcgggagagaugugcacaacguucaucuugccccggcuguggcccccaccuuuccuggagagcagcuccuguucuuucggucuacaaugcccggcuguuccggguauccuaauauggaccuggauugccugcucccccaggaguggguccagcacuucuaccaagaagcggcuccugcccagagcgacguggcccugcuucgcuuugugaaccccgauaccggaagaguucuguucgaguguaaacuccauaagucuggcuaugucacaguggcucacaccgggcagcacgaccuggugaucccgccuaauggcuacuuucgguucgauagcugggucaaccaguucuauacgcuugcccccaugggaaacggcaccgggagacgccgggcucuguga

SEQ ID NO: 27545 - RNA, 1623 nt, Artificial Sequence; identical to SEQ ID NO: 27532
  derived and/or modified sequence opt5 from VP1__Norovirus__BAJ13597

SEQ ID NO: 27546 - RNA, 1623 nt, Artificial Sequence
  derived and/or modified sequence opt5 from VP1__Norovirus__BAJ13603
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgggcucuguga

SEQ ID NO: 27547 - RNA, 1623 nt, Artificial Sequence
  derived and/or modified sequence opt5 from VP1__Norovirus__BAJ13606
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaguccugacgcagaccacaaagggcgacgggagcacccggggacacaaggcuacaguguacaccggcuccgccccguuuacgccuaaacucgggucuguucaguucagcacagauaccggagacgauuuucaaacccaucagaacacaaaguucacccccgugggcgucauucaggacggcgggacaacgcaccgcaaugaaccccaacagugggugcugccuuccuacagcggaagaaacguuccgaaugugcaccuugcccccgcugucgccccuaccuuucccggcgagcagcuccuguucuuucggucuacaaugccuggguguuccggauaucccaacauggaucuggacugccugcucccucaggaaugggugcaacauuucuaccaggaggcggcucccgcccagagcgauguggcccugcuucgcuuuguuaauccggacaccggcagaguccuguucgaguguaaacuccacaaggcuggguaugugacaguggcccauaccggccagcacgaucuggucaucccucccaacggauacuuucgguucgacucuugggugaaucaauucuauacgcuugcuccuaugggcaacgggaccggaagacgccgggcccuguga

SEQ ID NO: 27548 - RNA, 1623 nt, Artificial Sequence
  derived and/or modified sequence opt5 from VP1__Norovirus__BAJ13609
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacauuaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauaccaaguucacacccgugggagucauccaggacggcagcaccacacaccgcaacgaaccccagcaaugggugcugccuuccuacagcggcagaaauguucacaacgugcaucuugccccggcugucgcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguggcccugcuucgcuuuguuaaccccgacacagggagaguccuguucgaguguaaacuccauaagucuggauaugugaccguggcucacacaggccagcacgaucuggucauuccgccuaacggguacuuucgguucgacagcugggugaaucaguucuauacccuuacgcccaugggcaacggaaccggcagacgccgggcccuguga

SEQ ID NO: 27549 - RNA, 1623 nt, Artificial Sequence
  derived and/or modified sequence opt5 from VP1__Norovirus__BAJ13612
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcgggacaacgcaccgcaaugaaccccagcaaugggugcugccuagcuacuccggaagagauguucacaacgugcaucuugccccggcugucgcccccaccuuuccuggcgagcagcuccuguucuuucggagcacaaugcccggguguucuggauauccuaauauggaccuggauugccugcucccccaggagugggugcagcacuucuaccaagaagcggcuccugcccaguccgacguggcccugcuucgcuuuguuaaccccgauaccggcagaguccuguucgaguguaaacuccauaagagcggguaugugacaguggcucacaccggccagcacgaccuggucaucccgccuaauggauacuuucgguucgauucuugggugaaccaguucuauacgcuugcccccaugggcaacgggaccggaagacgccgggcucuguga

SEQ ID NO: 27550 - RNA, 1623 nt, Artificial Sequence
  derived and/or modified sequence opt5 from VP1__Norovirus__BAJ13615
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccagucugauguggcccugcuucgcuuuguuaaccccgacaccggcagaguccuguucgaguguaaacuccauaaguccggguaugugacaguggcucacaccggccagcacgaucuggucaucccgccuaacggauacuuucgguucgacagcugggugaaucaguucuauacgcuugcccccaugggcaacgggaccggaagacgccgggcucuguga

SEQ ID NO: 27551 - RNA, 1623 nt, Artificial Sequence
  derived and/or modified sequence opt5 from VP1__Norovirus__BAJ13618
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucagaacgugcaccuugccccggcugucgcccccaccuuuccuggggagcagcuccuguucuuucggucuacaaugcccggauguuccggcuauccuaauauggaucuggacugccugcucccccaggagugggugcaacauuucuaccaggaagcggcuccugcccagagcgauguggcccugcuucgcuuuguuaaccccgacaccgggagaguccuguucgaguguaaacuccacaagucuggauaugugacaguggcucauaccggccagcacgaucuggucaucccgccuaacggguacuuucgguucgacagcugggugaaucaauucuauacgcuugcccccaugggcaacggagcuggcagacgccgggcccuguga

SEQ ID NO: 27552 - RNA, 1623 nt, Artificial Sequence; identical to SEQ ID NO: 26802
  derived and/or modified sequence opt5 from VP1__Norovirus__BAJ13621

SEQ ID NO: 27553 - RNA, 1623 nt, Artificial Sequence
  derived and/or modified sequence opt5 from VP1__Norovirus__BAJ13624
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgcuguccagccucagaauggacgguguacaaccgacggcgugcuccuggggacgacacaacugucccccguuaacaucugcaccuuucgcggagaugugacacauaucgcgggcagcagaaauuacaccaugaaccucgccucucugaauuggaacaauuaugacccuaccgaagagauucccgcuccucuuggcacacccgauuucgucgggaaaauccagggagugcugacgcagaccacaaagggcgacggguccacccggggacacaaggccacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugccgaacguucaccuugcucccgccguggcgccuaccuuucccggggagcagcuccuguucuuucggucuacaaugccuggauguuccggcuaucccaauauggaucuggacugccugcucccucaggaguggguccagcauuucuaccaagaagcugcccccgcccagagcgauguggcucugcuucgcuuugugaacccggacaccgggagaguucuguucgaguguaaacuccacaagucuggauaugucacaguggcccauaccggccagcacgaucuggugaucccucccaacggguacuuucgguucgacagcugggucaaucaguucuauacgcuugcuccuaugggcaacggaaccggcagacgccgggcccuguga

SEQ ID NO: 27554 - RNA, 1623 nt, Artificial Sequence
  derived and/or modified sequence opt5 from VP1__Norovirus__BAJ13627
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccacgccguuuacaccuaaacucggaagcguucaguucuccaccgauaccgaaaaugacuuugagacacaucaaaacaccaaguucacacccgugggcgucauucaggauggcucuacgacccaccgcaaugaaccccagcaaugggugcugccuagcuacuccgggagaaacguucagaaugugcaccuugccccggccgucgcucccacauuuccuggagagcagcuccuguucuuucggagcaccaugcccggcuguucuggguauccuaacauggaccuggauugccugcucccccaggagugggugcaacauuucuaccaggaagccgcgccugcucaguccgacguggcccugcuucgcuuuguuaaucccgauacaggaagaguccuguucgaguguaaacuccacaagagcggcuaugugaccguggcccauacggggcagcacgaccuggucaucccgccuaacggcuacuuucgguucgauucuugggugaaccaauucuauacccuugcucccaugggaaauggcacagggagacgccgggcccuguga

SEQ ID NO: 27555 - RNA, 1623 nt, Artificial Sequence
  derived and/or modified sequence opt5 from VP1__Norovirus__BAJ13630
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaaggcuggcuaugugacaguggcccauaccgggcagcacgaucuggucaucccucccaacggcuacuuucgguucgacucuugggugaaccaguucuauacgcuugcuccuaugggaaauggcaccgggagacgccgggcccuguga

SEQ ID NO: 27556 - RNA, 1623 nt, Artificial Sequence
  derived and/or modified sequence opt5 from VP1__Norovirus__BAJ13633
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacacgcuucacccccgugggagucauucaggacggcggcacaacgcacagaaacgaaccccagcaaugggugcugccuagcuacuccgggcggaauguuccgaacgugcaccuugcccccgcugucgccccuaccuuucccggagagcagcuccuguucuuucgcagcacaaugccuggcuguucuggguaucccaauauggaucuggacugccugcucccucaggagugggugcagcauuucuaccaagaagcggcucccgcccaguccgauguggcccugcuuagauuuguuaacccggacaccggacggguccuguucgaguguaagcuccacaaaagcggcuaugugacaguggcucauaccgggcagcacgaucuggucaucccucccaacggcuacuuuagauucgacucuugggugaaucaguucuauacgcuugccccuaugggaaacggcaccgggcgccggagaguuagcuga

SEQ ID NO: 27557 - RNA, 1623 nt, Artificial Sequence; identical to SEQ ID NO: 27532
  derived and/or modified sequence opt5 from VP1__Norovirus__BAJ13636

SEQ ID NO: 27558 - RNA, 1623 nt, Artificial Sequence
  derived and/or modified sequence opt5 from VP1__Norovirus__BAJ13639
augaagauggccagcaacgacgcuaaucccuccgauggcucugccgcgaaccuggugcaggaggucaauaacgaaguuauggcucucgagccuguggugggggccgccaucgcugccccggucgcuggacaacagaaugugauugaccccuggaucagaaacaauuucguucaggccccuggcggggaauuuaccgugagcccccggaacgcgccuggagagauucugugguccgcuccccuuggcccugaucugaauccguaccucucucaccuggcccgcauguauaacggguacgccggaggcuucgaaguccaggugauccuugcuggcaaugccuuuacagcggggaaaauuaucuucgccgcuguucccccuaacuuucccacggagggacugagcccuucccaagugaccauguucccccauaucauugucgacgugagacagcucgagccggugcugaucccucugcccgauguccggaauaacuuuuaucacuacaaucagucuaacgacagcacaauuaagcucaucgccaugcuguauaccccucuucgcgcuaacaaugccggcgaagauguuuucacaguguccugcagagugcugacccggcccagccccgacuuugauuucauuuuucucgucccuccgacaguggagucucgcaccaaacccuucacgguuccuauccugaccguggaagagaugacaaacuccagauuucccauuccucuugagaagcuguucaccgggcccagcucugccuucgucgugcagccgcaaaauggacgguguacaaccgacggcguucuccuggggacgacacagcuguccccugugaacaucugcaccuuucgcggagaugucacacauaucgcuggcagcagaaauuacauuaugaaccucgcgucucugaauuggaacaauuaugaccccaccgaagagaucccugcuccccuuggcaccccugauuucguggggaaaauucagggaguccugacacagacgaccaagggcgacggguccacacggggacacaaggccaccguguacacaggcagcgcccccuuuaccccgaaacucggguccguucaauucucuacggacacagaaaacgauuuugagacccaucagaauaccaaguucacaccugugggagucauccaggacggcagcaccacacaccgcaacgaaccccaacagugggugcugcccuccuacagcggcgggaauguucacaacgugcaucuugccccugcugucgccccgacguuucccggagagcagcuccuguucuuuagaucuaccaugccuggcuguuccggguaucccaauauggaucuggacugccugcucccucaggagugggugcaacacuucuaccaggaagcggcucccgcccagagcgauguggcccugcuucgguuuguuaacccugacacaggacgcguccuguucgaguguaaacuccauaagucuggcuaugugaccguggcucacacagggcagcacgaucuggucauucccccgaacggcuacuuuagauucgacagcugggugaaucaauucuauacccuugccccuaugggaaacggcacggggcggagacgcgcucuguga

SEQ ID NO: 27559 - RNA, 1623 nt, Artificial Sequence; identical to SEQ ID NO: 27532
  derived and/or modified sequence opt5 from VP1__Norovirus__BAJ13642

SEQ ID NO: 27560 - RNA, 1623 nt, Artificial Sequence
  derived and/or modified sequence opt5 from VP1__Norovirus__BAJ13648
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagagauguucacaaugugcaucuugccccggcugucgcccccaccuuuccuggcgagcagcuccuguucuuucgguccacaaugcccggguguagcggauauccuaacauggaccuggauugccugcucccccaggagugggugcagcacuucuaccaagaagcggcuccugcccagucugacguggcccugcuucgcuuuguuaaucccgauaccggcagaguccuguucgaguguaaacuccauaaguccggguaugugacaguggcucacaccggccagcacgaccuggucaucccgccuaacggauacuuucgguucgauagcugggugaaccaguucuauacgcuugcccccaugggcaaugggaccggaagacgccgggcucuguga

SEQ ID NO: 27561 - RNA, 1623 nt, Artificial Sequence
  derived and/or modified sequence opt5 from VP1__Norovirus__BAJ13651
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccuccgagauucuguggucugccccucuuggaccggaucugaaucccuaccucagccaccuggcucgcauguauaacggcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgacuccacaauuaagcucaucgccaugcuguauacaccccuucgcgcuaacaaugccggagaagauguuuucaccgugagcugcagagugcugacccggcccucuccugacuuugauuucauuuuucucgucccgcccacaguggagucccgcaccaaaccuuucacgguucccauccugaccguggaagagaugacaaacagcagauuuccuauuccccuugagaagcuguucaccggcccgucuuccgccuucgucgugcagccucagaaugggcgguguacaaccgacggaguucuccugggcacgacacaacugagccccgugaacaucugcaccuuucgcggggaugucacacauaucgcuggaucuagaaauuacaccaugaaccucgcguccauuaauuggaacaauuaugacccuaccgaagagauccccgccccucugggcacacccgauuucgugggcaaaauucaggggguccuuacgcagaccacaaagggagacggcagcacccgggggcacaaggcuacaguguacaccggauccgccccguuuacgccuaaacugggcucuguucaguucagcacagacaccgaaaacgauuuugagacccaucaaaauacaaaguucacccccgugggggucauccaggacggaggcacaacgcaccagaacgaaccccaacagugggugcucccuggcuacuccgggcgcaauguuccgaacgugcaccuggcccccgcugucgccccuaccuuucccggagagcagcuucuguucuuuagaagcacaaugccuggcuguucuggguaucccaauauggaucucgacugccugcugccucaggagugggugcaacauuucuaccaggaagcggcucccgcccaguccgauguggcccuccugcgguuuguuaacccggacaccggacgcguccuuuucgaguguaaacugcacaagagcggcuaugugacaguggcucauaccgggcagcacgaucucgucauuccucccaacggcuacuuuagauucgacucuugggugaaucaauucuauacgcuggccccuaugggaaacggcaccgggcggagacgcgcucuuuga

SEQ ID NO: 27562 - RNA, 1623 nt, Artificial Sequence
  derived and/or modified sequence opt5 from VP1__Norovirus__BAJ13654
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaaucgagucucgcaccaaaccuuucacggugcccauucugaccguugaagagaugacaaacuccagauuuccuaucccccuugagaagcuguucaccgggccgagcggagccuucgugguccagccucagaauggccgguguacaaccgacggggugcuccugggaacgacacaacugucucccguuaacaucugcaccuuucgcggcgaugugacacauauugcuggcuccagagacuacaccaugaaucucgcgagccugaacuggaauaacuaugauccuaccgaagagauccccgccccucuugggacacccgacuucgucggaaaaauucagggcgugcugacgcagaccacaaagggggacggaucuacccggggccacaaggcuacagucuacaccggguccgccccguuuacgccuaaacucggaagcgugcaguucuccacagauaccgaaaaugacuuugagacccaucaaaacacaaaguucacccccguuggcgugauccaggauggcucuacaacgcaccgcaaugaaccccagcaauggguccugccuagcuacuccgggagaggagugcacaacguucaucuugccccggcuguggcccccaccuuuccuggcgagcagcuccuguucuuucggagcacaaugcccggguguucuggauauccuaauauggaccuggauugccugcucccccaggaguggguccagcacuucuaccaagaagcggcuccugcccaguccgacguggcccugcuucgcuuugugaaccccgauaccggcagaguucuguucgaguguaaacuccauaagagcggguaugucacaguggcucacaccggccagcacgaccuggugauuccgccuaauggauacuuucgguucgauucuugggucaaccaguucuauacgcuugcccccaugggcaacgggaccggaagacgccgggcucuguga

SEQ ID NO: 27563 - RNA, 1623 nt, Artificial Sequence
  derived and/or modified sequence opt5 from VP1__Norovirus__BAJ13657
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccagccuuggcccugaucugaacccguaccucucccaccuggcucgcauguauaauggguacgccggaggcuucgaaguccaggugauccuugcuggcaacgccuuuacagcggggaaaauuaucuucgccgcuguucccccuaauuuucccacggagggacugucuccuagccaggugaccauguucccccauaucauugucgacgugagacaacucgagccggugcugaucccucugcccgauguccggaacaauuuuuaucacuacaaccaguccaaugacagcacaauuaagcucaucgccaugcuguauaccccucuucgcgcuaacaacgccggcgaagauguuuucacagugucuugcagagugcugacccggcccucccccgacuuugauuucauuuuucucgucccuccgacaguggagagccgcaccaaacccuucacgguuccuauccugaccguggaagagaugacaaauucuagauuucccauuccucuugagaagcuguucaccgggcccuccagcgccuucgucgugcagccgcagaacggacgguguacaaccgacggcguucuccuggggacgacacaacugucuccugugaauaucugcaccuuucgcggagaugucacacauaucgcuggcuccagaaacuacaccaugaaucucgcgagccugaacuggaauaacuaugaccccaccgaagagauuccugcuccccuuggcacaccugauuucguggggaaaauccagggaguccugacgcagaccacaaagggcgacggguccacccggggacacaaggccacaguguacaccggcucugcccccuuuacgccgaaacucgggagcguucaguucuccacagacaccgaaaaugauuuugagacccaucaaaacacaaaguucaccccugugggagucauucaggacggcggcacaacgcaccgcaaugaaccccagcaaugggugcugcccagcuacucugggagaaacguucagaaugugcaccuugccccugcugucgccccgaccuuucccggagagcagcuccuguucuuucgguccacaaugccuggcuguagcggguaucccaacauggaucuggacugccugcucccucaggagugggugcaacauuucuaccaggaagcggcucccgcccagucugauguggcccugcuucgcuuuguuaauccugacaccggaagaguccuguucgaguguaaacuccacaagagcggcuaugugacaguggcucauaccgggcagcacgaucuggucauucccccgaacggcuacuuucgguucgacuccugggugaaccaauucuauacgcuugccccuaugggaaauggcaccgggagacgccgggcucuguga

SEQ ID NO: 27564 - RNA, 1623 nt, Artificial Sequence
  derived and/or modified sequence opt5 from VP1__Norovirus__BAJ13660
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauuccuugguccgccccgcugggccccgaucuuaauccuuaccugucucaccucgcucgcauguauaacggguacgccggaggcuucgaaguccaggugauccuggcuggcaaugccuuuacagcggggaaaauuaucuucgccgcuguucccccuaacuuucccacggagggacuuagcccgucccaggugaccauguucccucauaucauugucgacgugagacaacuggagcccgugcucaucccucugcccgauguccggaauaacuuuuaucacuacaaucagucuaacgacagcacaauuaagcugaucgccaugcucuauacaccccugcgcgcuaacaaugccggcgaagauguuuucaccguguccugcagagugcuuacccggccuagcccggacuuugauuucauuuuucuggugcccccuacagucgagucucgcaccaaacccuucacgguuccuauccucaccguggaagagaugacaaacuccagauuucccauuccgcuggagaaacuuuucaccgggccuagcucugccuucgucgugcagccccagaauggacgguguacaaccgacggcguucugcucgggacgacacaacuguccccugugaacaucugcaccuuucgcggagaugucacacauaucgcuggcagcagagacuacaccaugaaucuggcgucucucaacuggaauaacuaugaucccaccgaagagauuccugcuccccugggcacaccggacuucguggggaagauccagggaguccuuacgcagaccacaaagggcgacggguccacccggggacacaaggccacaguguacaccggcagcgccccuuuuacgcccaaacugggguccguucgcuucucuacagauaccgaaaaugacuuugagacccaucagaacacaaaguucacccccgugggagucauucaagauggcagcacaacgcacagaaaugaaccucagcagugggugcucccguccuacagcggccgggacguucacaacgugcaucuggcccccgcugucgccccuaccuuucccggggagcaacuucuguucuuucgcucuacaaugccuggauguuccggcuaucccaauauggaucucgacugccugcugccucaggagugggugcagcacuucuaccaggaagcggcucccgcccaaagcgauguggcccuccugagauuuguuaacccggacaccgggcggguccuuuucgaguguaaacugcauaagucuggauaugugacaguggcucacaccggccagcacgaucucgucaucccucccaauggguacuuuagauucgacagcugggugaaccaguucuauacgcuggccccuaugggcaacggaaccggccgccggagagcucuuuga

SEQ ID NO: 27565 - RNA, 1623 nt, Artificial Sequence
  derived and/or modified sequence opt5 from VP1__Norovirus__BAJ13663
augaagauggccagcaacgacgcuaaucccuccgauggcucugccgcgaaccuggugccugaggucaauaacgaagggauggcucucgagccgguugugggagccgccaucgcugcccccguggcuggccagaccaaugucaucgacccuuggaucagaaacaauuucgugcaagcccccgggggagaauuuacaguuagcccucggaacgcgcccuccgagauucuguggucugccagccuuggcccugaucugaauccguaccucucccaccuggcucgcauguauaacggguacgccggaggcuucgaagugcaggucauccuugcuggcaaugccuuuacggcggggaaaauuaucuucgccgcugugcccccuaacuuucccaccgagggacugucuccuagccagguuacaauguucccccauaucauuguggacgucagacagcucgagccggugcugaucccucugcccgaugugcggaauaacuuuuaucacuacaaucaauccaacgacagcaccauuaagcucaucgccaugcuguauacaccucuucgcgcuaacaaugccggcgaagaugucuucaccguuucuugcagagugcugacacggcccucccccgacuuugauuucauuuuucucgugccuccgaccgucgagagccgcacgaaacccuucaccgugccuauccugacaguugaagagaugaccaacucuagauuucccauuccucuugagaagcuguucacagggcccuccggagccuucgugguccagccgcagaauggccgguguaccacggacggggugcuccugggaacaacccagcugagcccuguuaacaucugcacauuucgcggcgaugugacccauaucgcuggcucuagaaauuacaccaugaaccucgcgucccugaauuggaacaauuaugaccccacagaagagauuccugcuccccuugggacgccugauuucgucggaaaaauccaaggcgugcugacccagacaaccaaggggaacggaagcacacggggccacaaggccaccgucuacacgggguccgcccccuuuacaccgaaacucggaucugugcaguucagcaccgacaccgaaaaugacuuugagacacaucagaacaccaaguucacaccuguuggcgugauucaagauggcuccacgacccaccgcaaugaaccccagcaguggguccugcccagcuacucugggagauccgugcacaacguucaucuugccccugcuguggccccgacauuucccggagagcaacuccuguucuuucggagcaccaugccuggcuguucuggguaucccaauauggaccuggauugccugcucccucaggaguggguccagcacuucuaccaggaagcggcucccgcccaaagcgacguggcccugcuucgcuuugugaacccugauacaggaagaguucuguucgaguguaaacuccauaaguccggcuaugucaccguggcucacacggggcagcacgaccuggugauucccccgaacggcuacuuucgguucgauucuugggucaaucaguucuauacccuugccccuaugggaaacggcacagggagacgccgggcucuguga

SEQ ID NO: 27566 - RNA, 1623 nt, Artificial Sequence
  derived and/or modified sequence opt5 from VP1__Norovirus__BAJ13666
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagauaucacacauauugcuggcagcagaaauuacaccaugaaccucgcgucucugaauuggaacaauuaugacccuaccgaagagauccccgccccucuuggcacacccgauuucgucgggaaaauucagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauccaggacggcagcacaacgcaccgcaacgaaccccagcaauggguccugccuuccuacagcggcagaaaugcccacaacgugcaucuugcuccggccguugcgcccaccuuuccuggggagcagcuccuguucuuucggucuacaaugcccggauguuccggcuauccuaauauggaucuggacugccugcucccccaggagugggugcagcacuucuaccaagaagcugccccugcccagagcgaugucgcucugcuucgcuuugugaaccccgacaccgggagagugcuguucgaguguaaacuccauaagucuggauauguuacagucgcccacaccggccagcacgaucuggugauuccgccuaacggguacuuucgguucgacagcugggugaaucaguucuauacgcuugcucccaugggcaacggaaccggcagacgccgggcccuguga

SEQ ID NO: 27567 - RNA, 1623 nt, Artificial Sequence
  derived and/or modified sequence opt5 from VP1__Norovirus__BAJ13669
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucggaacagacaccgagaacgauuuugaaacccaucaaaauacaaaguucaccccugugggcgucauucaggacggcucuacaacgcaccgcaacgagccccagcaaugggugcugcccagcuacuccgggagaaauguucacaacgugcaucuugccccugcugucgccccgaauuuucccggagaacagcuccuguucuuucggagcaccaugccuggcuguucuggguaucccaacauggaucuggacugccugcucccucaggagugggugcagcacuucuaccaagaggcggcucccgcccaguccgauguggcccugcuucgcuuuguuaacccugacacaggaagaguccuguucgaauguaaacuccauaagagcggcuaugugaccguggcucacacagggcagcacgaucuggucauucccccgaauggcuacuuucgguucgacucuugggugaaccaguucuauacccuugccccuaugggaaauggcacggggagacgccgggcucuguga

SEQ ID NO: 27568 - RNA, 1623 nt, Artificial Sequence
  derived and/or modified sequence opt5 from VP1__Norovirus__BAJ13672
augaagauggccagcaacgacgcuaauagauccgauggcucugccgcgaaccuggugcccgaggucaauaacgaaguuauggcucucgagccuguggugggggccgccaucgcugccccggucgcuggacagcaaaaugugauugaccccuggauccggaacaauuucguucaggccccuggcggggaauuuaccgugagcccccgcaacgcgccuggagagauucugugguccgcuccccuuggcccugaucugaauccguaccucucucaccuggccagaauguauaacggguacgccggaggcuucgaaguccaggugauccuugcuggcaaugccuuuacagcggggaaaauuaucuucgccgcuguucccccuaacuuucccacggagggacugagcccuucccaggugaccauguucccccauaucauugucgacgugcggcaacucgagccggugcugaucccucugcccgauguccgcaauaacuuuuaucacuacaaucagucuaacgacagcacaauuaagcucaucgccaugcuguauaccccucuuagagcuaacaaugccggcgaagauguuuucacaguguccugccgggugcugacccgccccagccccgacuuugauuucauuuuucucgucccuccgacaguggagucuagaaccaaacccuucacgguuccuauccugaccguggaagagaugacaaacucccgguuucccauuccucuugagaagcuguucaccgggcccagcucugccuucgucgugcagccgcagaauggacgcuguacaaccgacggcguucuccuggggacgacacaacuguccccugugaacaucugcaccuuuagaggagaugucacacauaucgcuggcagccggaauuacaccaugaaccucgcgucucugaauuggaacaauuaugaccccaccgaagagauuccugcuccccuuggcacaccugauuucguggggaaaauccagggaguccugacgcagaccacaaagggcgacggguccacccgcggacacaaggccacaguguacaccggcagcgcccccuuuacgccgaaacucggguccguucaguucucuacagacaccgaaaacgauuuugagacccaucaaaauacaaaguucaccccugugggagucauucaggacggcagcacaacgcacagauccgaaccccagcaaugggugcugcccagcuacucuggccggaacguuccuaaugugcaccuugccccggcugucgcccccaccuuuccuggggagcagcuccuguucuuucgcuccacaaugcccggauguagcggcuauccuaacauggaucuggacugccugcucccccaggagugggugcagcauuucuaccaagaagcggcuccugcccagucugauguggcccugcuuagauuuguuaaucccgacaccgggcggguccuguucgaguguaaacuccacaagagcggauaugugacaguggcucauaccggccagcacgaucuggucaucccgccuaacggguacuuuagauucgacuccugggugaaccaguucuauacgcuugcccccaugggcaauggaaccggccgccggagagcucuguga

SEQ ID NO: 27569 - RNA, 1623 nt, Artificial Sequence
  derived and/or modified sequence opt5 from VP1__Norovirus__BAJ13675
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacagcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgacuccacaauuaagcucaucgccaugcuguauacaccccuucgcgcuaacaaugccggagaagauguuuucaccgugagcugcagagugcugacccggcccucuccugacuuugauuucauuuuucucgucccgcccacaguggagucccgcaccaaaccuuucacgguucccauccugaccguggaagagaugacaaacagcagauuuccuauuccccuugagaagcuguucaccggcccgucuuccgccuucgucgugcagccucagaaugggcgguguacaaccgacggaguucuccugggcacgacacaacugagccccgugaacaucugcaccuuucgcggggaugucacacauaucgcuggaucuagaaauuacaccaugaaccucgcgucccugaauuggaacaauuaugacccuaccgaagagauucccgccccucuuggcacacccgauuucgugggcaaaauccaggggguccugacgcagaccacaaagggagacggcagcacccgggggcacaaggcuacaguguacaccggauccgccccguuuacgccuaaacucggcucuguucaguucagcacagacaccgaaaacgauuuugagacccaucaaaauacaaaguucacccccgugggggucauucaggacggaggcacaacgcaccgcaacgaaccccagcaaugggugcugccuuccuacagcggcagagauguucacaaugugcaucuugccccggcugucgcccccaccuuuccuggggagcagcuccuguucuuucggucuacaaugcccggauguuccggcuauccuaacauggaccuggauugccugcucccccaggagugggugcagcacuucuaccaagaagcggcuccugcccagagcgacguggcccugcuucgcuuuguuaaucccgauaccgggagaguccuguucgaguguaaacuccauaagucuggauaugugacaguggcucacaccggccagcacgaccuggucaucccgccuaacggguacuuucgguucgauagcugggugaaccaguucuauacgcuugcccccaugggcaauggaaccggcagacgccgggcucuguga

SEQ ID NO: 27570 - RNA, 1623 nt, Artificial Sequence
  derived and/or modified sequence opt5 from VP1__Norovirus__BAJ13678
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagagacuacaccaugaaucucgcgagccugaacuggaauaacuaugauccuacagaagagauucccgccccucuugggacgcccgacuucgugggaaaaauccaaggcguccugacccagacaaccaagggggacggaucuacacggggccacaaggcuaccguguacacgggguccgccccguuuacaccuaaacucggaagcguucaguucuccaccgauaccgaaaaugacuuugaggcccaucagaacacaaaguucacccccgugggcgucauucaagauggcucuacaacgcaccgcaaugaaccccagcagugggugcugccuagcuacuccgggagaaacguucaaaaugugcaccuugcuccggccgucgcgcccaccuuuccuggagagcagcuccuguucuuucggagcacaaugcccggcuguucuggguauccuaacauggaccuggauugccugcucccccaggagugggugcagcauuucuaccaagaagcugccccugcccaguccgacguggcucugcuucgcuuuguuaaucccgauaccggaagaguccuguucgaguguaaacuccacaagagcggcuaugugacaguggcccauaccgggcagcacgaccuggucaucccgccuaacggcuacuuucgguucgauucuugggugaaccaguucuauacgcuugcucccaugggaaauggcaccgggagacgccgggcccuguga

SEQ ID NO: 27571 - RNA, 1623 nt, Artificial Sequence
  derived and/or modified sequence opt5 from VP1__Norovirus__BAJ13681
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaagacacaaaguucacccccgugggagucauucaggauggcggcacaacgcaccgcaacgaaccccagcaaugggugcugccuuccuacagcgggagaaauguucagaacgugcaccuugccccggcugucgcccccaccuuuccuggagagcagcuccuguucuuucggucuacaaugcccggcuguuccggguauccuaauauggaccuggauugccugcucccccaggagugggugcaacauuucuaccaggaagcggcuccugcccagagcgacguggcccugcuucgcuuuguuaaccccgauaccggaagaguccuguucgaguguaaacuccacaagucuggcuaugugacaguggcucauaccgggcagcacgaccuggucaucccgccuaauggcuacuuucgguucgauagcugggugaaccaauucuauacgcuugcccccaugggaaacggcaccgggagacgccgggcucuguga

SEQ ID NO: 27572 - RNA, 1623 nt, Artificial Sequence
  derived and/or modified sequence opt5 from VP1__Norovirus__BAJ13684
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgugucccugaacuggaauaacuaugacccuaccgaagagauucccgcgccucuuggcacacccgauuucgucgggaaaauccagggagugcugacgcagaccacaaagggcgacgggagcacccggggacacaaggccacaguuuacaccggcuccgcuccguuuacgccuaaacucgggucugugcaguucagcacagacaccgaaaaugauuuugagacccaucaaaacacaaaguucacccccgucggagugauucaggacggcuccacaacgcaccgcaaugaaccccagcaauggguucugccuagcuacucuggcagaaacgugcacaauguccaucuugccccggccguggcucccaccuuuccuggggagcagcuccuguucuuucgguccacaaugcccggauguagcggcuauccuaacauggaucuggacugccugcucccccaggagugggugcagcacuucuaccaagaagccgcgccugcucagucugauguugcccugcuucgcuuugucaaucccgacaccgggagagugcuguucgaguguaaacuccauaagagcggauaugugacagucgccuacaccggccagcacgaucuggugaucccgccuaacggguauuuucgguucgacuccuggguuaaccaguucuacacgcuugcucccaugggcaauggaaccggcagacgccgggcccuguga

SEQ ID NO: 27573 - RNA, 1623 nt, Artificial Sequence
  derived and/or modified sequence opt5 from VP1__Norovirus__BAJ13687
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucaucguccagccucagaauggacgguguacaaccgauggcgugcuccuggggacgacacaacugucccccguuaacaucugcaccuuucgcggagacgugacacauauugcuggcagcagaaauuacaccaugaaccucgcgucucugaauuggaacaauuaugauccuaccgaggaaauccccgccccucuuggcacacccgacuucgucgggaaaauucagggagugcugacgcagaccacaaagggcgacggguccacccggggacacaaggcuacagucuacaccggcagcgccgauuuuacgccgaaacucggguccgugcaguucggaacagacaccgagaacgauuuugaaacccaucaaaauacaaaguucaccccuguuggcgugauccaggacggcucuacaacgcaccgcaacgagccccagcaauggguccugcccagcuacuccgggagaaaugugcacaacguucaucuugccccugcuguggccccgaauuuucccggagaacagcuccuguucuuucggagcaccaugccuggcuguucuggguaucccaacauggaucuggacugccugcucccucaggaguggguccagcacuucuaccaagaggcggcucccgcccaguccgauguggcccugcuucgcuuugugaacccugacacaggaagaguucuguucgaauguaaacuccauaagagcggcuaugucaccguggcucacacagggcagcacgaucuggugauucccccgaauggcuacuuucgguucgacucuugggucaaccaguucuauacccuugccccuaugggaaauggcacggggagacgccgggcucuguga

SEQ ID NO: 27574 - RNA, 1623 nt, Artificial Sequence
  derived and/or modified sequence opt5 from VP1__Norovirus__BAJ13690
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgagaacgacuuugaaacccaucaaaauacaaaguucacccccgugggagucauucaggauggcagcacaacgcaccgcaacgagccccagcaaugggugcugccuuccuacagcggcagaaauguucacaacgugcaucuugccccggcugucgcccccaccuuuccuggggaacagcuccuguucuuucggucuacaaugcccggauguuccggcuauccuaauauggaccuggauugccugcucccccaggagugggugcagcacuucuaccaagaggcggcuccugcccagagcgacguggcccugcuucgcuuuguuaaccccgauaccgggagaguccuguucgaauguaaacuccauaagucuggauaugugacaguggcucacaccggccagcacgaccuggucaucccgccuaacggguacuuucgguucgauagcugggugaaucaguucuauacgcuugcccccaugggcaacggaaccggcagacgccgggcucuguga

SEQ ID NO: 27575 - RNA, 1623 nt, Artificial Sequence
  derived and/or modified sequence opt5 from VP1__Norovirus__BAJ13693
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguuaaagcccccggcggggaauuuaccgugagcccucggaacucccccggagagauucuguggucugcgccucuuggcccggaucugaaucccuaccucagccaccuggcccgcauguauaacggguacgcuggaggcuucgaaguccaggugauccuugccggcaaugcuuuuacagccgggaagauuaucuucgcggccguuccucccaacuuuccuacggagggacugucccccucucaggugaccauguucccgcauaucauugucgacgugagacagcucgagccugugcugaucccccugccugauguccggaauaacuuuuaucacuacaaucaaagcaacgacuccacaauuaaacucaucgcuaugcuguauacaccccuucgcgccaacaaugcuggcgaugacguuuucaccgugagcugcagagugcugacccggcccucuccugauuuugacuucauuuuucucgucccgcccacaguggaaucccgcaccaagccuuucacgguucccauccugaccguggaggaaaugacaaacagcagauuuccuauuccccuugagaaacuguucaccgggccgucuuccgccuucaucguccagccucagaauggacgguguacaaccgauggcgugcuccuggggacgacacagcugagccccguuaacaucugcaccuuucgcggagacgugacacauauugccggcucuagaaauuacaccaugaaccucgcuucccugaauuggaacaauuaugauccuaccgaggaaguccccgcgccucuuggcacacccgacuucguggggaagauccaaggaguccugacgcagaccacaaagggcgacgggagcacccggggacacaaagccacaguguacaccggcuccgcugauuuuacgccgaagcucgggucuguucaguucggaacagacaccgagaacgauuuugaaacccaucagaauacaaaauucaccccugugggcgucauucaagacggcagcacaacgcaccgcaacgagccccagcagugggugcugcccuccuacagcgggagaaauguucacaacgugcaucuugccccugccgucgcuccgaauuuucccggagaacaacuccuguucuuucggucuaccaugccuggcuguuccggguaucccaacauggaucuggacugccugcucccucaggagugggugcagcacuucuaccaggaggccgcgcccgcucaaagcgauguggcccugcuucgcuuuguuaacccugacacaggaagaguccuguucgaauguaagcuccauaaaucuggcuaugugaccguggcccacacagggcagcacgaucuggucauucccccgaauggcuacuuucgguucgacagcugggugaaccaguucuauacccuugcuccuaugggaaauggcacggggagacgccgggcccuguga

SEQ ID NO: 27576 - RNA, 1623 nt, Artificial Sequence
  derived and/or modified sequence opt5 from VP1__Norovirus__BAJ13696
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacacgcuucacccccgugggagucauucaggacggcggcacaacgcacagaaacgaaccccagcaaugggugcugccuagcuacuccgggcggaauguuccgaacgugcaccuugcccccgcugucgccccuaccuuucccggagagcagcuccuguucuuucgcagcacaaugccuggcuguucuggguaucccaauauggaucuggacugccugcucccucaggagugggugcagcauuucuaccaagaagcggcucccgcccaguccgauguggcccugcuuagauuuguuaacccggacaccggacggguccuguucgaguguaagcuccacaaaagcggcuaugugacaguggcucauaccgggcagcacgaucuggucaucccucccaacggcuacuuuagauucgacucuugggugaaucaguucuauacgcuugccccuaugggaaacggcaccgggcgccggagaguucuguga

SEQ ID NO: 27577 - RNA, 1623 nt, Artificial Sequence
  derived and/or modified sequence opt5 from VP1__Norovirus__BAJ13699
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcggcccugaauuggaacaauuaugacccuaccgaagagauucccgcuccucuugggacacccgauuucgugggaaaaauccagggcguccugacgcagaccacaaagggggacggaagcacccggggccacaaggccacaguguacaccgggucugccgacuuuacgccgaaacucggauccguucaguucagcacagauaccgaaaacgacuuugagacccaucaaaauacaaaguucaccccugugggcgucauucaggauggcuccacaacgcaccgcaacgaaccccagcaaugggugcugcccucuuacagcgggagaaauguucacaacgugcaucuugcuccugccgucgcgccgaccuuucccggagagcagcuccuguucuuucgguccacaaugccuggcuguagcggguaucccaauauggaccuggauugccugaucccucaggagugggugcagcacuucuaccaagaagcugcccccgcccagucugacguggcucuccugcgcuuuguuaacccugauaccggaagaguccuuuucgaguguaaacugcauaaguccggcuaugugacaguggcccacaccgggcagcacgaccucgucauucccccgaacggcuacuuucgguucgauagcugggugaaucaguucuauacgcuggcuccuaugggaaacggcgccgggagacgccgggcgcuuuga

SEQ ID NO: 27578 - RNA, 1623 nt, Artificial Sequence
  derived and/or modified sequence opt5 from VP1__Norovirus__BAJ13702
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugaggcccaucagaauacaaaguucacccccgugggcgucauucaagacggcucuacaacgcaccgcaacgaaccccagcagugggugcugccuagcuacuccgggagaaaugcucaaaacguucaccuugccccggcgguggcucccaccuuuccuggagagcagcuccuguucuuucggagcacaaugcccggcuguucuggguauccuaauauggaucuggacugccugcucccccaggaguggguccagcauuucuaccaagaagccgccccugcucaguccgauguggcccugcuucgcuuugugaaccccgacaccggaagaguucuguucgaguguaaacuccacaagagcggcuaugucacaguggcucauaccgggcagcacgaucuggugaucccgccuaacggcuacuuucgguucgacucuugggucaaucaguucuauacgcuugcccccaugggaaacggcaccgggagacgccgggcgcuguga

SEQ ID NO: 27579 - RNA, 1623 nt, Artificial Sequence
  derived and/or modified sequence opt5 from VP1__Norovirus__BAJ13711
augaagauggccagcaacgacgcuaaucccuccgauggcucugccgcgaaccuggugccugaggucaauaacgaaguuauggcucucgagccgguggugggggccgccaucgcugcccccgucgcugcccagcaaaaugugauugacccuuggaucagaaacaauuucguucaggcgcccggaggcgaauuuaccgugagcccucggaacgcccccuccgagauucuguggucugcuccucuugggccggaucugaaucccuaccucagccacuucgcccgcauguauaacugcuacgcuggaggcuuugaaguccaggugauccuggccgggaaugcguucacagccggaaaaauuaucuuugcugccguuccucccaacuucccuacggagggccuuucccccucucaggugaccauguuuccgcauaucauugucgacgugagacaacuggagccugugcucaucccccugccugauguccggaauaacuucuaucacuacaaucagagcaacgacuccacaauuaagcugaucgcuaugcucuauacaccccugcgcgccaacaaugccggcgaagauguuuuuaccgugagcuguagagugcuuacccggcccucuccugacuucgauuuuauuuuccuggucccgcccacaguggagucccgcaccaaaccuuuuacgguucccauccucaccguggaagagaugacaaacagcagauucccuauuccccuggagaaacuuuucaccgggccgucuuccgcuuuugucgugcagccucagaauggacggugcacaaccgacggcguucugcucgggacgacacaacugagccccgugaacaucuguaccuuccgcggagaugucacacauaucgcgggcucuagaaauuacaccaugaaccuggccucccucaauuggaacaauuaugacccuaccgaagagauucccgcuccucuggggacacccgauuuugugggaaagauccagggcguccuuacgcagaccacaaagggcgacgggagcacccggggacacaaggccacaguguacaccggcuccgccccguucacgccuaaacuggggucuguucaguuuagcacagacaccgaaaacgauuucgagacccaucaaaauacaaaguuuacccccgugggagucauucaggacggcgggacaacgcaccgcaacgaaccccagcaaugggugcucccuuccuacagcggaagaaauguuccgaacgugcaccuggcucccgccgucgcgccuaccuuccccggcgagcagcuucuguuuuuccggucuacaaugccuggcugcuccggguaucccaauauggaucucgacugucugcugccucaggagugggugcagcauuuuuaccaagaagcugcccccgcccagagcgauguggcucuccugcgcuucguuaacccggacaccggaagaguccuuuuugagugcaaacugcacaagucuggcuaugugacaguggcccauaccgggcagcacgaucucgucaucccucccaacggauacuuccgguucgacagcugggugaaucaguuuuauacgcuggcuccuaugggcaacgggaccggcagacgccgggcccuuuga

SEQ ID NO: 27580 - RNA, 1623 nt, Artificial Sequence; identical to SEQ ID NO: 27544
  derived and/or modified sequence opt5 from VP1__Norovirus__BAJ13714

SEQ ID NO: 27581 - RNA, 1623 nt, Artificial Sequence
  derived and/or modified sequence opt5 from VP1__Norovirus__BAJ13717
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauguggcuggcagcagaaauuacaucaugaaccucgcgucucugaauuggaacaauuaugacccuaccgaagagauucccgccccucuuggcacccccgauuucgucgggaaaauccagggagugcugacacagacgaccaagggcgacggguccacacggggacacaaggcuaccguuuacacaggcagcgccccguuuaccccuaaacucggguccgugcaguucucuacggacacagaaaacgauuuugagacccaucaaaauaccaaguucacacccgucggagugauucaggacggcagcaccacacaccgcaacgaaccccagcaauggguucugccuuccuacagcggcagaaaugugcacaacguccaucuugccccggcuguggcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguugcccugcuucgcuuugucaaccccgacacagggagagugcuguucgaguguaaacuccauaagucuggauaugugaccgucgcucacacaggccagcacgaucuggugaucccgccuaacggguacuuucgguucgacagcuggguuaaucaguucuauacccuugcccccaugggcaacggaacgggcagacgccgggcucuguga

SEQ ID NO: 27582 - RNA, 1623 nt, Artificial Sequence
  derived and/or modified sequence opt5 from VP1__Norovirus__BAJ13720
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacgucugcaccuuucgcggagaugugacacauaucgcuggcagcagaaauuacaccaugaaccucgcgucucugaauuggaacaauuaugacccuaccgaagagauccccgccccucuuggcacacccgauuucgucgggaaaauucagggagugcugacgcagaccacaaagggcgacggguccacccggggacacaaggcuacaguuuacaccggcagcgccccguuuacgccuaaacucggguccgugcaguucucuacagacaccgaaaacgauuuugagacccaucaaaauacaaaguucacccccgucggagugauccaggacggcggcacaacgcaccgcaacgaaccccagcaauggguucugccuagcuacuccgggagagaugugccgaauguccaccuugcccccgcuguggccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguugcccugcuucgcuuugucaauccggauaccggaagagugcuguucgaguguaaacuccacaagagcggcuaugugacagucgcucauaccgggcagcacgaccuggugauuccucccaacggcuacuuucgguucgauucuuggguuaaccaguucuauacgcuugccccuaugggaaauggcaccgggagacgccgggcucuguga

SEQ ID NO: 27583 - RNA, 1623 nt, Artificial Sequence
  derived and/or modified sequence opt5 from VP1__Norovirus__BAJ13723
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccgugcugaccgucgaagagaugacaaacuccagauuuccuaucccccuugagaagcuguucaccgggccgagcucugccuucgugguucagccucagaauggacgguguacaaccgacggcgugcuccuggggacgacacaacugucccccgucaacauuugcaccuuucgcggagaugugacacauaucgcuggcagcagagacuacaccaugaaucucgcgucucugaacuggaauaacuaugauccuaccgaagagauccccgccccucuuggcacacccgacuucgucgggaaaauucagggagugcugacgcagaccacacggggcgacggguccacccgcggacacaaggcuacaguuuacaccggcagcgccccguuuacgccuaagcucggguccgugcaguucucuacagauaccgaaaaugacuuugagacccaucaaaacacaaaauucacccccgucggagugauccaggauggcggcacaacgcacagaaaugaaccccagcaauggguucugccuagcuacuccgggcggaacgugccgaauguccaccuugcccccgcuguggccccuaccuuucccggagagcagcuccuguucuuucgcagcacaaugccuggcuguucuggguaucccaacauggaccuggauugccugcucccucaggagugggugcagcauuucuaccaagaagcggcucccgcccaguccgacguugcccugcuuagauuugucaauccggauaccggacgggugcuguucgaguguaagcuccacaaaagcggcuaugugacagucgcucauaccgggcagcacgaccuggugauuccucccaacggcuacuuuagauucgauucuuggguuaaccaguucuauacgcuugccccuaugggaaauggcaccgggcgccggagagcucuguga

SEQ ID NO: 27584 - RNA, 1623 nt, Artificial Sequence
  derived and/or modified sequence opt5 from VP1__Norovirus__BAJ13726
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggagacgccgggcucuguga

SEQ ID NO: 27585 - RNA, 1623 nt, Artificial Sequence; identical to SEQ ID NO: 27544
  derived and/or modified sequence opt5 from VP1__Norovirus__BAJ13729

SEQ ID NO: 27586 - RNA, 1623 nt, Artificial Sequence; identical to SEQ ID NO: 27495
  derived and/or modified sequence opt5 from VP1__Norovirus__BAJ13732

SEQ ID NO: 27587 - RNA, 1623 nt, Artificial Sequence; identical to SEQ ID NO: 26802
  derived and/or modified sequence opt5 from VP1__Norovirus__BAJ13738

SEQ ID NO: 27588 - RNA, 1623 nt, Artificial Sequence
  derived and/or modified sequence opt5 from VP1__Norovirus__BAJ13741
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcaguacgaucuggucaucccgccuaacggcuauuuucgguucgacucuugggugaaucaguucuacacgcuugcccccaugggaaacggcaccgggagacgccgggcucuguga

SEQ ID NO: 27589 - RNA, 1623 nt, Artificial Sequence; identical to SEQ ID NO: 27532
  derived and/or modified sequence opt5 from VP1__Norovirus__BAJ13744

SEQ ID NO: 27590 - RNA, 1623 nt, Artificial Sequence; identical to SEQ ID NO: 27022
  derived and/or modified sequence opt5 from VP1__Norovirus__BAJ13747

SEQ ID NO: 27591 - RNA, 1623 nt, Artificial Sequence; identical to SEQ ID NO: 27081
  derived and/or modified sequence opt5 from VP1__Norovirus__BAJ13750

SEQ ID NO: 27592 - RNA, 1623 nt, Artificial Sequence; identical to SEQ ID NO: 27022
  derived and/or modified sequence opt5 from VP1__Norovirus__BAJ13753

SEQ ID NO: 27593 - RNA, 1623 nt, Artificial Sequence
  derived and/or modified sequence opt5 from VP1__Norovirus__BAJ13756
augaagauggccagcuccgacgcuaaucccccugauggcucugccgcgaaccuggugccggaggucaacaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucugugguccgccccgcuuggccccgaucugaacccuuaccucucucaccuggcucgcauguauaauggguacgccggaggcuucgaaguccaggugauccuugcuggcaacgccuuuacagcggggaaaauuaucuucgccgcuguucccccuaauuuucccacggagggacugagcccgucccaggugaccauguucccucauaucauugucgacgugagacaacucgagcccgugcugaucccucugcccgauguccggaacaauuuuuaucacuacaaccagucuaaugacagcacaauuaagcucaucgccaugcuguauacaccccuucgcgcuaacaacgccggcgaagauguuuucaccguguccugcagagugcugacccggccuagcccggacuuugauuucauuuuucucgugcccccuacagucgagucucgcaccaaacccuucacgguuccuauccugaccguggaagagaugacaaauuccagauuucccauuccgcuugagaagcuguucaccgggccuagcggagccuucgucgugcagccccagaacggccgguguacaaccgacgggguucuccugggaacgacacaacugucuccugugaauaucugcaccuuucgcggcgaugucacacauaucgcuggcuccagaagcuacaccaugaaccucgcgucucugaauuggaacaauuaugaccccaccgaagagauuccugcuccccuugggacaccggauuucgugggaaaaauccagggcaugcugacgcagaccacaaagggggacggauccacccggggccacaaggccacagucuacaccgggagcgccccuuuuacgcccaaacucggauccgugcaguucucuacagacaccgaaaacgauuuucaaacccaucagaauacaaaguucacccccguuggcgugauucaggacggcagcacaacgcaccgcaacgagccucaacaguggguccugccguccuacagcgggagagaugugcacaauguucaucuugcccccgcuguggccccuaccuuucccggagaacagcuccuguucuuucggucuacaaugccuggcuguuccggguaucccaacauggaccuggauugccugcucccucaggaguggguccaacacuucuaccaggaggcggcucccgcccagagcgacguggcccugcuucgcuuugugaauccggauaccggaagaguucuguucgaauguaaacuccauaagucuggcuaugucacaguggcucacaccgggcagcacgaccuggugaucccucccaacggcuacuuucgguucgauagcugggucaaucaauucuauacgcuugccccuaugggaaacggcaccgggagacgccgggcucuguga

SEQ ID NO: 27594 - RNA, 1623 nt, Artificial Sequence
  derived and/or modified sequence opt5 from VP1__Norovirus__BAJ13759
augaagauggccagcaacgacgcuaaucccuccgauggcucugccgcgagccuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugagacaacucgagccugugcugaucccccugccugauguccggaauaacuuuuaucacuacaaucaguccaacgacagcacaauuaagcucaucgccaugcuguauacaccccuucgcgcuaauaacgccggcgaagauguuuucaccgugucuugcagagugcugacccggcccuccccugacuuugauuucauuuuucucgucccgcccacaguggagagccgcaccaaaccuuucacgguucccauccugaccguggaagagaugacaaacucuagauuuccuauuccccuugagaagcuguucaccgggccguccggagccuucgucgugcagccucagaauggccgguguacaaccgacgggguucuccugggaacgacacaacugagccccgugaacaucugcaccuuucgcggcgaugucacacauaucgcuggcucuagaaauuacaccaugaaccucgcgucccugaauuggaacaauuaugacccuaccgaagagauucccgccccucuugggacacccgauuucgugggaaaaauccagggcguccugacgcagaccacaaagggggacggaagcacccggggccacaaggcuacaguguacaccggguccgccccguuuacgccuaaacucggaucuguucaguucagcacagacaccgaaaacgauuuugagacccaucaaaauacaaaguucacccccgugggcgucauucaggacggcuccacaacgcaccgcaacgaaccccagcaaugggugcugccuagcuacucugggagagauguucacaaugugcaucuugccccggcugucgcccccaccuuuccuggagagcagcuccuguucuuucgguccacaaugcccggcuguagcggguauccuaacauggaccuggauugccugcucccccaggagugggugcagcacuucuaccaagaagcggcuccugcccagucugacguggcccugcuucgcuuuguuaaucccgauaccggaagaguccuguucgaguguaaacuccauaagagcggcuaugugacaguggcucacaccgggcagcacgaccuggucaucccgccuaacggcuacuuucgguucgauuccugggugaaucaguucuauacgcuugcccccaugggaaacggcaccgggagacgccgggcucuguga

SEQ ID NO: 27595 - RNA, 1623 nt, Artificial Sequence; identical to SEQ ID NO: 27081
  derived and/or modified sequence opt5 from VP1__Norovirus__BAJ13762

SEQ ID NO: 27596 - RNA, 1623 nt, Artificial Sequence; identical to SEQ ID NO: 27081
  derived and/or modified sequence opt5 from VP1__Norovirus__BAJ13765

SEQ ID NO: 27597 - RNA, 1623 nt, Artificial Sequence; identical to SEQ ID NO: 27584
  derived and/or modified sequence opt5 from VP1__Norovirus__BAJ13768

SEQ ID NO: 27598 - RNA, 1623 nt, Artificial Sequence
  derived and/or modified sequence opt5 from VP1__Norovirus__BAJ13771
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugaucgacccuuggaucagaaacaauuucguucaagcccccggcggggaauuuacagugagcccucggaacgcgcccggagagauucugugguccgccgcucuuggcccugaucugaauccguaccucucucaccuggcccgcauguauaacggguacgcuggaggcuucgaaguccaggugauccuugccggcaaugcguuuacggccgggaaaauuaucuucgcugccguucccccuaacuuucccaccgagggacugagcccuucccaggugacaauguucccccauaucauugucgacgugagacagcucgagccggugcugaucccucugcccgauguccggaauaacuuuuaucacuacaaucaaucuaacgacagcaccauuaagcucaucgcuaugcuguauacaccucuucgcgccaacaaugccggcgaagauguuuucaccguguccugcagagugcugacacggcccagccccgacuuugauuucauuuuucucgucccuccgaccguggagucucgcacgaaacccuucaccguuccuauccugacaguggaagagaugaccaacuccagauuucccauuccucuugagaagcuguucacagggcccagcggagcuuucgucgugcagccgcagaauggccgguguaccacggacgggguucuccugggaacaacccagcugucuccugugaacaucugcacauuucgcggcgaugucacccauaucgcgggcuccagaaauuacaccaugaaccucgccagccugaauuggaacaauuaugaccccacagaagagauuccugcuccccuugggacgccugauuucgugggaaaaauccaaggcguccugacccagacaaccaagggggacggaucuacacggggccacaaggccaccguguacacgggguccgcccccuuuacaccgaaacucggaagcguucaguucuccaccgacaccgaaaacgauuuugagacacaucagaauaccaaguucacaccugugggcgucauucaagacggcucuacgacccaccgcaacgaaccccagcagugggugcugcccagcuacuccgggagaaauguucacaacgugcaucuugcuccugccgucgcgccgacauuucccggagagcaacuccuguucuuucggagcaccaugccuggcuguucuggguaucccaauauggaucuggacugccugcucccucaggagugggugcagcacuucuaccaggaagcugcccccgcccaauccgauguggcucugcuucgcuuuguuaacccugacacaggaagaguccuguucgaguguaaacuccauaagagcggcuaugugaccguggcccacacggggcagcacgaucuggucauucccccgaacggcuacuuucgguucgacucuugggugaaucaguucuauacccuugcuccuaugggaaacggcacagggagacgccgggcccuguga

SEQ ID NO: 27599 - RNA, 1623 nt, Artificial Sequence; identical to SEQ ID NO: 27532
  derived and/or modified sequence opt5 from VP1__Norovirus__BAJ13774

SEQ ID NO: 27600 - RNA, 1623 nt, Artificial Sequence
  derived and/or modified sequence opt5 from VP1__Norovirus__BAJ13777
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcggagccuucgucgugcagccucagaauggccgguguaccacggaugggguucuccugggaacaacccagcugucucccgugaacaucugcacauuucgcggcgacgucacccauaucgcuggcuccagaaauuacaccaugaaccucgcgagccugaauuggaacaauuaugauccuacagaggaaauucccgccccucuugggacgcccgacuucgugggaaaaauccaaggcguccugacccagacaaccaagggggacggaucuacacggggccacaaggcuaccguguacacgggguccgccccguuuacaccuaaacucggaagcguucaguucuccaccgauaccgagaacgacuuugaagcccaucagaauacaaaguucacccccgugggcgucauucaagauggcucuacaacgcaccgcaacgagccccagcagugggugcugccuagcuacuccgggagaaauguucaaaacgugcaccuugcuccggccgucgcgcccaccuuuccuggagaacagcuccuguucuuucggagcacaaugcccggcuguucuggguauccuaauauggaccuggauugccugcucccccaggagugggugcagcauuucuaccaagaggcugccccugcccaguccgacguggcucugcuucgcuuuguuaaccccgauaccggaagaguccuguucgaauguaaacuccacaagagcggcuaugugacaguggcccauaccgggcagcacgaccuggucaucccgccuaacggcuacuuucgguucgauucuugggugaaucaguucuauacgcuugcucccaugggaaacggcaccgggagacgccgggcccuguga

SEQ ID NO: 27601 - RNA, 1623 nt, Artificial Sequence; identical to SEQ ID NO: 27532
  derived and/or modified sequence opt5 from VP1__Norovirus__BAJ13780

SEQ ID NO: 27602 - RNA, 1623 nt, Artificial Sequence; identical to SEQ ID NO: 27532
  derived and/or modified sequence opt5 from VP1__Norovirus__BAJ13783

SEQ ID NO: 27603 - RNA, 1623 nt, Artificial Sequence; identical to SEQ ID NO: 27081
  derived and/or modified sequence opt5 from VP1__Norovirus__BAJ13786

SEQ ID NO: 27604 - RNA, 1623 nt, Artificial Sequence
  derived and/or modified sequence opt5 from VP1__Norovirus__BAJ13792
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugguucuugcuggcaaugccuuuacagcggggaaagugaucuucgccgcugucccucccaacuuuccuacggagggacugagccccucccaggugaccauguucccgcauauuaucguggacgucagacaacucgagccuguucugaucccccugccugaugugcggaauaacuuuuaucacuacaaucagucuaacgacagcacaauuaagcucaucgccaugcuguauacaccccuucgcgcuaacaaugccggcgaagauguguucaccgucuccugcagagugcugacccggcccagcccugacuuugauuucauuuuucucguuccgcccacaguggagucucgcaccaaaccuuucacgguccccauccugaccguggaagagaugacaaacuccagauuuccuauuccccuugagaagcuguucaccgggccgagcggagccuucguugugcagccucagaauggccgguguacaaccgacgggguccuccugggaacgacacaacugucucccgugaacaucugcaccuuucgcggcgaugucacacauauugcuggcuccagaaauuacaccaugaaccucgcgagccugaauuggaacaauuaugacccuaccgaagagauccccgccccucuugggacacccgauuucgugggaaaaauccagggcguucugacgcagaccacaaagggggacggaucuacccggggccacaaggcuacaguguacaccggguccacgccguuuacaccuaaacucggaagcguccaguucuccaccgacaccgaaaacgauuuugagaaucaucaaaacacaaaguucacccccgugggcguuauucaggacggcgggacaacgcaccgcaaugaaccccagcaaugggugcugccuucuuacagcggaagaaacguccagaaugugcaccuugccccggccguggcucccaccuuuccuggcgagcagcuccuguucuuucgguccacaaugcccggguguagcggauauccuaacauggaucuggacugccugcucccccaggaguggguucaacauuucuaccaggaagccgcgccugcucagucugaugucgcccugcuucgcuuugugaaccccgacaccggcagagugcuguucgaguguaaacuccacaaguccggguaugucacaguggcccauaccggccagcacgaucugguuaucccgccuaauggauacuuucgguucgacagcugggugaaccaauucuauacgcuugcucccaugggcaaugggaccggaagacgccgggcccuguga

SEQ ID NO: 27605 - RNA, 1623 nt, Artificial Sequence
  derived and/or modified sequence opt5 from VP1__Norovirus__BAJ13795
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauuccuugguccgccccgcugggccccgaucuuaauccuuaccugucucaccucgcucgcauguauaacggguacgccggaggcuucgaaguccaggugguucuggcuggcaaugccuuuacagcggggaaagugaucuucgccgcugugcccccuaacuuucccacggagggacuuagcccgucccaggucaccauguucccucauauuaucguggacgucagacaacuggagcccguucucaucccucugcccgaugugcggaauaacuuuuaucacuacaaucagucuaacgacagcacaauuaagcugaucgccaugcucuauacaccccugcgcgcuaacaaugccggcgaagauguguucaccgucuccugcagagugcuuacccggccuagcccggacuuugauuucauuuuucugguucccccuacaguggagucucgcaccaaacccuucacggucccuauccucaccguggaagagaugacaaacuccagauuucccauuccgcuggagaaacuuuucaccgggccuagcggagccuucguugugcagccccagaauggccgguguacaaccgacgggguccugcucggaacgacacaacugucuccugugaacaucugcaccuuucgcggcgaugucacacauauugcuggcuccagaaauuacaccaugaaccuggcgagccucaauuggaacaauuaugaccccaccgaagagaucccugcuccccuggggacaccggauuucgugggaaagauccagggcguucuuacgcagaccacaaagggggacggaucuacccggggccacaaggccacaguguacaccggguccacgccuuuuacacccaaacugggaagcguccaguucuccaccgacaccgaaaacgauuuugagaaucaucaaaacacaaaguucacccccgugggcguuauucaggacggcgggacaacgcaccgcaaugaaccucagcaaugggugcucccgucuuacagcggaagaaacguccagaaugugcaccuggcccccgccguggcuccuaccuuucccggcgagcagcuucuguucuuucgguccacaaugccuggguguagcggauaucccaacauggaucucgacugccugcugccucaggaguggguucaacauuucuaccaggaagccgcgcccgcucagucugaugucgcccuccugcgcuuugugaacccggacaccggcagagugcuuuucgaguguaaacugcacaaguccggguaugucacaguggcccauaccggccagcacgaucucguuaucccucccaauggauacuuucgguucgacagcugggugaaccaauucuauacgcuggcuccuaugggcaaugggaccggaagacgccgggcccuuuga

SEQ ID NO: 27606 - RNA, 1623 nt, Artificial Sequence
  derived and/or modified sequence opt5 from VP1__Norovirus__BAJ13801
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugguucuugcuggcaaugccuuuacagcggggaaaaucauuuucgccgcugugccucccaacuuuccuacggagggacugagccccucccaggucaccauguucccgcauaucaucguggacgugagacaacucgagccuguccugauuccccugccugauguucggaauaacuuuuaucacuacaaucagucuaacgacagcacaaucaagcucauugccaugcuguauacaccccuucgcgcuaacaaugccggcgaagauguguucaccguguccugcagaguccugacccggcccagcccugacuuugauuucaucuuucucgugccgcccacaguugagucucgcaccaaaccuuucacggugcccauucugaccgucgaagagaugacaaacuccagauuuccuaucccccuugagaagcuguucaccgggccgagcggagccuucgugguucagccucagaauggccgguguacaaccgacggggugcuccugggaacgacacaacugucucccgucaacauuugcaccuuucgcggcgaugugacacauaucgcuggcuccagaaauuacaccaugaaccucgcgagccugaauuggaacaauuaugacccuaccgaagagauccccgccccucuugggacacccgauuucgucggaaaaauucagggcgugcugacgcagaccacaaagggggacggaucuacccggggccacaaggcuacaguuuacaccggguccacgccguuuacaccuaaacucggaagcgugcaguucuccaccgacaccgaaaacgauuuugagaaucaucaaaacacaaaguucacccccgucggcgugauccaggacggcgggacaacgcaccgcaaugaaccccagcaauggguucugccuucuuacagcggaagaaacgugcagaauguccaccuugccccggccguggcucccaccuuuccuggcgagcagcuccuguucuuucgguccacaaugcccggguguagcggauauccuaacauggaucuggacugccugcucccccaggagugggugcaacauuucuaccaggaagccgcgccugcucagucugauguugcccugcuucgcuuugucaaccccgacaccggcagagugcuguucgaguguaaacuccacaaguccggguaugugacagucgcccauaccggccagcacgaucuggugauuccgccuaauggauacuuucgguucgacagcuggguuaaccaauucuauacgcuugcucccaugggcaaugggaccggaagacgccgggcccuguga

SEQ ID NO: 27607 - RNA, 1623 nt, Artificial Sequence
  derived and/or modified sequence opt5 from VP1__Norovirus__BAJ13804
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucagaacgugcaccuugccccggcugucgcccccaccuuuccuggagagcagcuccuguucuuucggagcacaaugcccggcuguucuggguauccuaauauggaucuggacugccugcucccccaggagugggugcaacauuucuaccaggaagcggcuccugcccaguccgauguggcccugcuucgcuuuguuaaccccgacaccggaagaguccuguucgaguguaaacuccacaagagcggcuaugugacaguggcucauaccgggcagcacgaucuggucaucccgccuaacggcuacuuucgguucgacucuugggugaaucaauucuauacgcuugcccccaugggaaacggcaccgggagacgccgggcucuguga

SEQ ID NO: 27608 - RNA, 1623 nt, Artificial Sequence; identical to SEQ ID NO: 27081
  derived and/or modified sequence opt5 from VP1__Norovirus__BAJ13807

SEQ ID NO: 27609 - RNA, 1623 nt, Artificial Sequence; identical to SEQ ID NO: 27607
  derived and/or modified sequence opt5 from VP1__Norovirus__BAJ13810

SEQ ID NO: 27610 - RNA, 1623 nt, Artificial Sequence; identical to SEQ ID NO: 27607
  derived and/or modified sequence opt5 from VP1__Norovirus__BAJ13816

SEQ ID NO: 27611 - RNA, 1623 nt, Artificial Sequence
  derived and/or modified sequence opt5 from VP1__Norovirus__BAJ13819
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucauccauauugcuggcuccagaaauuacacaaugaaccucgcggcccugaauuggaacaauuaugacccuaccgaagagauccccgcuccucuugggacccccgauuucgugggaaaaauucagggcguccugacacagacgaccaagggggacggaagcacacggggccacaaggccaccguguacacagggucugccgacuuuaccccgaaacucggauccguucaguucagcacggauacagaaaacgacuuugagacccaucaaaauaccaaguucacaccugugggcgucauccaggauggcuccaccacacaccgcaacgaaccccagcaaugggugcugcccucuuacagcgggagaaauguucacaacgugcaucuugcuccugccgucgcgccgacguuucccggagagcagcuccuguucuuucgguccaccaugccuggcuguagcggguaucccaauauggaccuggauugccugcucccucaggagugggugcagcacuucuaccaagaagcugcccccgcccagucugacguggcucugcuucgcuuuguuaacccugauacaggaagaguccuguucgaguguaaacuccauaaguccggcuaugugaccguggcccacacagggcagcacgaccuggucauucccccgaacggcuacuuucgguucgauagcugggugaaucaguucuauacccuugcuccuaugggaaacggcacggggagacgccgggcccuguga

SEQ ID NO: 27612 - RNA, 1623 nt, Artificial Sequence; identical to SEQ ID NO: 27607
  derived and/or modified sequence opt5 from VP1__Norovirus__BAJ13822

SEQ ID NO: 27613 - RNA, 1623 nt, Artificial Sequence
  derived and/or modified sequence opt5 from VP1__Norovirus__BAJ13825
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucaccccgcccacggucgagucucgcaccaaaccuuucacagugcccauccugaccguugaagagaugacaaacuccagauuuccuauuccccuugagaagcuguucaccgggccgagcggagccuucgugguccagccucagaauggccgguguacgacagacggggugcuccugggaaccacacagcugucucccguuaacaucugcaccuuucgcggcgaugugacccauaucgcuggcuccagaaauuacacaaugaaccucgcgagccugaauuggaacaauuaugacccuacggaagagauucccgccccucuugggacccccgauuucgucggaaaaauccaaggcgugcugacacagaccacaaagggggacggaucuacccggggccacaaggcuacggucuacacaggguccgccccguuuaccccuaaacucggaagcgugcaguucuccaccgacacagaaaacgauuuugaggcccaucagaauaccaaguucacacccguuggcgugauucaagacggcucuacgacccaccgcaacgaaccccagcaguggguccugccuagcuacuccgggagaaaugugcaaaacguucaccuugcuccggccguggcgcccacauuuccuggagagcagcuucucuucuuucggagcaccaugcccggcuguucuggguauccuaauauggaucuggacugccugcucccccaggaguggguccagcauuucuaccaagaagcugccccugcccaguccgaucuggcucugcugcgcuuugugaaccccgacacaggaagaguucucuucgaguguaaacugcacaagagcggcuaugugaccgucgcccauacggggcagcacgaucuugugaucccgccuaacggcuacuuucgguucgacucuugggugaaucaguucuauacccuggcucccaugggaaacggcacagggagacgccgggcccucuga

SEQ ID NO: 27614 - RNA, 1623 nt, Artificial Sequence
  derived and/or modified sequence opt5 from VP1__Norovirus__BAJ13828
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcauagccuguauuuccggucuacaaugccuggcuguuccggguaccccaauauggaucucgacugccugcugccucaggagugggugcagcacuuuuaucaggaagcggcucccgcccaaagcgauguggcccuccugcgcuucguuaacccggacaccggaagaguccuuuuugaguguaaacugcauaagucuggcuacgugacaguggcucacaccgggcagcacgaucucgucaucccucccaacggcuauuuccgguuugacagcugggugaaucaguucuacacgcuggccccuaugggaaacggcaccgggagacgccgggcucuuuga

SEQ ID NO: 27615 - RNA, 1623 nt, Artificial Sequence; identical to SEQ ID NO: 27081
  derived and/or modified sequence opt5 from VP1__Norovirus__BAJ13831

SEQ ID NO: 27616 - RNA, 1623 nt, Artificial Sequence; identical to SEQ ID NO: 26802
  derived and/or modified sequence opt5 from VP1__Norovirus__BAJ13834

SEQ ID NO: 27617 - RNA, 1623 nt, Artificial Sequence; identical to SEQ ID NO: 27081
  derived and/or modified sequence opt5 from VP1__Norovirus__BAJ13837

SEQ ID NO: 27618 - RNA, 1623 nt, Artificial Sequence
  derived and/or modified sequence opt5 from VP1__Norovirus__BAJ13840
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcuguuuuuacgccgaaacucgggagcgugcaguucuccacagacaccgaaaaugauuuugagacccaucaaaacacaaaguucaccccugucggagugauucaggacggcucuacaacgcaccgcaaugaaccccagcaauggguucugcccagcuacuccggcagaaacgugcacaauguccaucuugccccugcgguggcuccgaccuuucccggggagcagcuccuguucuuucggagcacaaugccuggauguucuggcuaucccaacauggaucuggacugccugcucccucaggagugggugcagcacuucuaccaagaagccgcccccgcucaguccgauguugcccugcuucgcuuugucaauccugacaccgggagagugcuguucgaguguaaacuccauaagagcggauaugugacagucgcucacaccggccagcacgaucuggugauucccccgaacggguacuuucgguucgacucuuggguuaaccaguucuauacgcuugccccuaugggcaauggaaccggcagacgccgggcgcuguga

SEQ ID NO: 27619 - RNA, 1623 nt, Artificial Sequence; identical to SEQ ID NO: 27081
  derived and/or modified sequence opt5 from VP1__Norovirus__BAJ13843

SEQ ID NO: 27620 - RNA, 1623 nt, Artificial Sequence; identical to SEQ ID NO: 27081
  derived and/or modified sequence opt5 from VP1__Norovirus__BAJ13846

SEQ ID NO: 27621 - RNA, 1623 nt, Artificial Sequence; identical to SEQ ID NO: 27081
  derived and/or modified sequence opt5 from VP1__Norovirus__BAJ13849

SEQ ID NO: 27622 - RNA, 1623 nt, Artificial Sequence
  derived and/or modified sequence opt5 from VP1__Norovirus__BAJ13852
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagccuggcuaugugacaguggcucauaccgggcagcacgaucuggucauccccagcaacggcuacuuucgguucgacucuugggugaaucaguucuauacgcuugccccuaugggaaacggcaccgggagacgccgggcucuguga

SEQ ID NO: 27623 - RNA, 1623 nt, Artificial Sequence
  derived and/or modified sequence opt5 from VP1__Norovirus__BAJ13855
augaagauggccagcaacgacgcuaaucccuccgauggcucugccgcgaaccuggugccugaggucaauaacgaaguuauggcucucgacccgguggugggggccgccaucgcugcccccgucgcuggacagcaaaaugugauugauccuuggaucagaaacaauuucguucaggcccccggcggggaguuuaccgugagcccucggaacgcgcccggagaaauucugugguccgccccucuuggcccggaccugaaucccuaccucucucaccuggcucgcauguauaacggguacgccggaggcuucgagguccaggugauccuugcuggcaaugccuuuacagcggggaaaauuaucuucgccgcuguuccucccaacuuuccuacggaaggacugagccccucccaggugaccauguucccgcauaucauugucgaugugagacaacucgagccugugcugaucccccugccugacguccggaauaacuuuuaucacuacaaucagucuaacgauagcacaauuaagcucaucgccaugcuguauacaccccuucgcgcuaacaaugccggcgaggacguuuucaccguguccugcagagugcugacccggcccagcccugauuuugacuucauuugucucgucccgcccacaguggaaucucgcaccaaaccuuuuacgguucccauccugaccguggaggaaaugacaaacuccagauucccuauuccccuugagaagcuguuuaccgggccgagcucugccuucgucgugcagccucagaauggacggugcacaaccgauggcguucuccuggggacgacacaacugucccccgugaacaucuguaccuuccgcggagacgucacacauaucgcuggcagcagaaauuacaccaugaaccucgcgucucugaauuggaacaauuaugauccuaccgaggaaauucccgccccucuuggcacacccgacuuuguggggaaaauccagggaguccugacgcagaccacaaagggcgacggguccacccggggacacaaggcuacaguguacaccggcagcgccccguucacgccuaaacucggguccguucaguuuucuacagauaccgagaacgacuucgaaacccaucaaaauacaaaguuuacccccgugggagucauucaggauggcggcacaacgcaccgcaacgagccccagcaaugggugcugccuagcuacuccgggagaaauguuccgaacgugcaccuugcccccgcugucgccccuaccuuccccggagaacagcugcucuuuuuccggagcacaaugccuggcugcucuggguaucccaauauggaccuggauugucugcucccucaggagugggugcagcauuuuuaccaagaggcggcucccgcccaguccgacguggcccugcuucgcuucguuaacccggauaccggaagaguccuguuugaaugcaaacuccacaagagcggcuaugugacaguggcucauaccgggcagcacgaccuggucaucccucccaacggcuacuuccgguuugauucuugggugaaucaguucuauacgcuugccccuaugggaaacggcaccgggagacgccgggcucuguga

SEQ ID NO: 27624 - RNA, 1623 nt, Artificial Sequence; identical to SEQ ID NO: 26945
  derived and/or modified sequence opt5 from VP1__Norovirus__BAJ13858

SEQ ID NO: 27625 - RNA, 1623 nt, Artificial Sequence
  derived and/or modified sequence opt5 from VP1__Norovirus__BAJ13861
augaagaugagaagcuccgacgccaaccccucugauggcagcaccgcuaaucuggugccugaggucaacaaugaaguuauggcccucgagccgguggugggggcggcuaucgccgcccccgucgcuggacagcaaaacgugauugacccuuggauccggaauaacuucguucaggcccccggcggggaauuuacaguguccccucgcaaugcucccggagagauucuguggucugccccucuuggcccggaucugaaccccuaccucagccaccuggcgagaauguauaauggguacgccggaggcuucgaaguccaggugauccuugcuggcaacgccuuuacggcugggaaaauuaucuucgccgcgguuccucccaauuuuccuaccgagggacugucccccucucaggugacaauguucccgcauaucauugucgacgugcggcaacucgagccugugcugaucccccugccugauguccgcaacaauuuuuaucacuacaaccagagcaaugaccccaccauuaagcucaucgccaugcuguauacaccccuuagagcuaacaacgccggcgaugacguuuucaccggguccugccgggugcugacacgcccuagcccggauuuugacuucauuuuucucgugcccccuaccgucgaaucuagaacgaaacccuucuccgugagcuuuuucaccggagaggaaaugacaaauucucgguucccuaucccccuggagaaacuuuuuaccggcccguccagcgcuuucguugugcagccucagaacgggcgcuguacaaccgauggaguccugcucggcacgacacaacugucucccgugaauauuugcaccuuuagaggcgacguuacacauaucaccgggucccggaacuacaccaugaaucuggccacacagaacuggaauagcuaugauccuacggaggaaauccccgccccucucggaacccccgacuucgugggcaagauucaggggguccugacacagaccacacgcgcugacggauccaccagaggccacaaggcgacgguguacacagggucugccgauuuugcuccgaaacuuggacggguccaauucgccaccgacaccgauaacgacuuugaugccaaucagaacacaaaguucaccccugugggcguuauccaggacggcgauacagcucaucgcaaugagccccaacagugggugcugcccagcuacuccgggagaaacagccacaauguccaccucgccccugcgguggcuccgacguuucccggagaacagcugcuuuucuuucggucuaccaugccuggcuguuccggguaucccaacauggaccuggauugccuccugccucaggaguggguucaauacuucuaucaggaagccgcccccgcucagagcgacguggcccugcucagauuugucaauccugauacaggacgcgugcuguucgaguguaaacuucauaagucuggcuacgugaccguugcucacacagggcagcaugaccuggucauucccccgaacggcuauuuccgguuugacagcugggugaaccaauucuacacccucgccccuaugggaaauggcacggggagacgccgggcgcuguga

SEQ ID NO: 27626 - RNA, 1623 nt, Artificial Sequence; identical to SEQ ID NO: 26945
  derived and/or modified sequence opt5 from VP1__Norovirus__BAJ13864

SEQ ID NO: 27627 - RNA, 1623 nt, Artificial Sequence
  derived and/or modified sequence opt5 from VP1__Norovirus__BAJ13867
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuguauucucgaucugcccccuaccgucgaaucucgcacgaaacccuucuccgugccuauccuuaccguugaggaaaugacaaauagcagauuucccauuccgcuggagaagcuguucaccgggccuucuuccgccuuugugguccagccccagaacggacggugcacaaccgacggcgugcugcuggggacgacacaacucagcccuguuaauaucuguaccuuccgcggagaugugacacauaucaccggcucuagaaacuacaccaugaaucuggccacacagaacuggaacuccuaugaccccacggaggaaauuccugcuccccuuggcaccccggacuucgucgggaaaauccagggagugcugacacagaccacacgggcggauggcagcacccgcgggcacaaggccacggucuacacaggauccgcugacuuugccccuaagcucggcagagugcaauucgccaccgauaccgacaaugauuuugacgcuaaucagaacacaaaauucacccccguuggggugauucaggauggagacacagcccaucggaaugagccccaacaguggguccugccuucuuacagcggccgcaacucccacaaugugcaccuugcgccggcuguugcccccacguuuccuggcgaacagcuccucuucuuuagaagcaccaugcccgggugcucuggauauccuaacauggaucuggacugucugcucccccaggagugggugcaauacuucuaucaggaagccgcuccugcccaguccgaugucgcucugcuucgguuugugaaucccgacacaggcagagugcuguucgagugcaagcuccauaaaagcggguacguuaccgucgcccacacaggacagcaugaccuggugaucccgccuaacggcuauuuucgcuucgauucuugggugaaccaauuuuacacccuugcgcccauggggaauggcacgggacggagacgcgcccuguga

SEQ ID NO: 27628 - RNA, 1623 nt, Artificial Sequence
  derived and/or modified sequence opt5 from VP1__Norovirus__BAJ13873
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaaguuguguucaccgugagcugcagaguccugacccggcccucuccugauuuugacuucauuugucucgugccgcccacaguugagucccgcaccaaaccuuuuacggugcccauccugaccgucgaagagaugacaaauagcagauucccuauuccccuugagaagcuguuuaccgggccgucuuccgccuucgugguucagccucagaacggacggugcacaaccgauggcgugcuccuggggacgacacaacugagccccgucaauaucuguaccuuccgcggagacgugacacauaucgcuggcucuagaaacuacaccaugaaucucgcgucccugaacuggaauaacuaugauccuaccgaagagauucccgccccucuuggcacacccgacuuugucgggaaaauccagggagugcugacgcagaccacaaagggcgaugggagcacccggggacacaaggcuacaguuuacaccggcuccgccccguucacgccuaaacucgggucugugcaguuuagcacagacaccgaaaaugacuucgagacccaucaaaacacaaaguuuacccccgucggagugauucaggauggcggcacaacgcaccgcaaugaaccccagcaauggguucugccuuccuacagcgggagaaacgugccgaauguccaccuugcccccgcuguggccccuaccuuccccggagagcagcugcucuuuuuccggucuacaaugccuggcugcuccggguaucccaacauggaccuggauugucugcucccucaggagugggugcagcauuuuuaccaagaagcggcucccgcccagagcgacguugcccugcuucgcuucgucaauccggauaccggaagagugcuguuugagugcaaacuccacaagccuggcuaugugacagucgcucauaccgggcagcacgaccuggugauccccucuaacggcuacuuccgguuugauagcuggguuaaccaguucuauacgcuugccccuaugggaaauggcaccgggagacgccgggcucuguga

SEQ ID NO: 27629 - RNA, 1623 nt, Artificial Sequence
  derived and/or modified sequence opt5 from VP1__Norovirus__BAJ13876
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcggcccugaauuggaacaauuaugacccuaccgaagagauucccgcuccucuugggacacccgauuucgugggaaaaauccagggcguccugacgcagaccacaaagggggacggaagcacccggggccacaaggccacaguguacaccgggucugccgacuuuacgccgaaacucggauccguucaguucagcacagauaccgaaaacgacuuugagacccaucaaaauacaaaguucaccccugugggcgucauucaggauggcuccacaacgcaccgcaacgaaccccagcaaugggugcugcccucuuacagcgggagaaauguucacaacgugcaucuugcuccugccgucgcgccgaccuuucccggagagcagcuccuguucuuucgguccacaaugccuggcuguagcggguaucccaauauggaccuggauugccugcucccucaggagugggugcagcacuucuaccaagaagcugcccccgcccagucugacguggcucugcuucgcuuuguuaacccugauaccggaagaguccuguucgaguguaaacuccauaaguccggcuaugugacaguggcccacaccgggcagcacgaccuggucauucccccgaacggcuacuuucgguucgauagcugggugaaucaguucuauacgcuugcuccuaugggaaacggcaccgggagacgccgggcccuguga

SEQ ID NO: 27630 - RNA, 1623 nt, Artificial Sequence
  derived and/or modified sequence opt5 from VP1__Norovirus__BAJ13879
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccauggaccucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgaaaaugacuuugagacccaucaaaacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaauccggauaccggaagaguccuguucgaguguaaacuccacaagagcggcuaugugacaguggcucauaccgggcagcacgaccuggucaucccucccaacggcuacuuucgguucgauucuugggugaaccaguucuauacgcuugccccuaugggaaauggcaccgggagacgccgggcucuguga

SEQ ID NO: 27631 - RNA, 1623 nt, Artificial Sequence; identical to SEQ ID NO: 26802
  derived and/or modified sequence opt5 from VP1__Norovirus__BAJ13882

SEQ ID NO: 27632 - RNA, 1623 nt, Artificial Sequence
  derived and/or modified sequence opt5 from VP1__Norovirus__BAJ13885
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggaaauacagcccaucggaacgagccccaacagugggugcucccuucuuacagcggccgcaauucccacaacguucaccuggcgccggcuguggcccccacguuuccuggcgaacagcuucuguucuuuagaagcaccaugcccggguguucuggauauccuaauauggaucucgacugccugcugccccaggaguggguccaauacuucuaucaggaagccgcuccugcccaguccgauguggcucuccugcgguuugugaaccccgacacaggcagaguucuuuucgaguguaagcugcauaaaagcggguacgucaccguggcccacacaggacagcaugaucucgugaucccgccuaacggcuauuuucgcuucgacucuugggucaaucaauucuacacccuggcgcccauggggaacggcacgggacggagacgcgcccuuuga

SEQ ID NO: 27633 - RNA, 1623 nt, Artificial Sequence
  derived and/or modified sequence opt5 from VP1__Norovirus__BAJ13891
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgccucucgcacgaaacccuucuccguuccuagcgugaccgucgaagagaugacaaauucuagauuucccaucccgcuggaaaaacuuuucaccgggccuuccagcgccuucgugguucagccccagaacggacgguguacaaccgauggcgugcugcucgggacgacacaacugucuccugucaauauuugcaccuuucgcggagacgugacacauaucaccggcuccagaaacuacaccaugaaucuggcuacacagaacuggaauagcuaugaucccacggaggagaucccugcgccccucggcaccccggacuucgucgggaagauucagggagugcugacacagaccacacgggccgacggcuccacccgcgggcacaaggcuacgguuuacacaggaucugccgauuuugccccuaaacuuggcagagugcaauucgcuaccgacaccgauaacgacuuugaugccaaucagaacacaaaguucacccccgucggggugauccaggacggagauacagcgcaucggaaugaaccccaacaguggguucugccuagcuacuccggccgcaacagccacaaugugcaccucgcuccgacggucgcccccaccuuuccuggcgagcagcugcuuuucuuuagaucuacaaugcccggguguuccggauauccuaacauggaccuggauugccuccugccccaggaaugggugcaauacuucuaucaggaggccgcuccugcccagagcgacguggcucugcuccgguuuguuaaucccgauaccggcagaguccuguucgaauguaaacuucauaagucuggguacgugacaguggcccacaccggacagcaugaccuggucauuccgccuaacggcuauuuucgcuucgacagcugggugaaccaauucuacacgcucgcgcccauggggaauggcaccggacggagacgcgcccuguga

SEQ ID NO: 27634 - RNA, 1623 nt, Artificial Sequence
  derived and/or modified sequence opt5 from VP1__Norovirus__BAJ13894
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucagaacgcccccuccgagauucuguggucugcgccucuuggaccggaucugaaucccuaccucagccaccuggcccggauguauaacggcuacgcugggggauucgaaguccaggugauccuugccggcaaugcuuuuacggccggcaaaauuaucuucgcggccguuccucccaacuuuccuaccgaggggcugucccccucucaagugacaauguucccgcauaucauugucgacgugcgccagcucgagccugugcugaucccccugccugaugucagaaauaacuuuuaucacuacaaucagagcaacgaccccaccauuaagcucaucgcuaugcuguauacaccccuucgggccaacaaugcuggagaugacguuuucaccguguccugccgcgugcugacaagaccuagcccggauuuugacuucauuuuucucgugcccccuaccgucgaaucucggacgaaacccuucaccguuccuauccugacaguggaggaaaugaccaacucccgcuuucccauuccgcuugagagacuguacacaggcccuagcucugccuucgucgugcagccccaaaaugggcgguguaccacggauggaguucuccugggcacaacccagcuguccgccgugaacaucugcacauuccgcggggacgucacccauaucgcuggaagcagaaauuauaccaugaaccucgcgucucagaauuggaacaauuacgauccuacagaggaaauucccgccccucugggcacgcccgacuuugugggcaagauccaggggaugcuuacccaaacaacccgguccgacggaagcacacgcggccacaaagcuaccguccugacgggguccgccgauuucgccccgaagcucggaagagugcaguuugcuacagacaccgauaacgacuucgagucuggccagaauaccaaguuuacaccuguuggggugauucaagauggaagcaccacacaucggaacgaaccccagcaguggguccugcccaauuacuccggccgcacgggccacaacgugcaccuugccccugcgguugcuccgaccuaucccggggagcagcuccuguucuuuagaagcacaaugccuggauguucuggcuaccccaauauggaccuggauugccugcucccucaagaaugggugcagcauuucuaucaggaggccgcccccgcucaguccgacgucgcccugcuucgguuugugaacccugauaccgggagagugcuguucgaguguaaacuccacaagagcggauacguuacagucgcucauaccggccaacacgaccuggugauucccccgaacggguauuuucgcuucgauucuugggugaaucaguuuuacacgcuugccccuaugggcaacggaaccggccggagacgcgcggucuga

SEQ ID NO: 27635 - RNA, 1623 nt, Artificial Sequence
  derived and/or modified sequence opt5 from VP1__Norovirus__BAJ13897
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggagauacagcccaucggaaugagccccaacagugggugcucccuucuuacagcggccgcaacucccacaauguucaccuggcgccgacgguggcucccaccuuuccuggcgaacagcuucuguucuuuagaagcacaaugcccggguguucuggauauccuaacauggaccucgauugccugcugccccaggaguggguccaauacuucuaucaggaagccgccccugcucaguccgacguggcccuccugcgguuugugaaucccgauaccggcagaguucuuuucgaguguaagcugcauaaaagcggguacgucacaguggcucacaccggacagcaugaccucgugaucccgccuaacggcuauuuucgcuucgacucuugggucaaccaauucuacacgcuggcccccauggggaauggcaccggacggagacgcgcgcuuuga

SEQ ID NO: 27636 - RNA, 1623 nt, Artificial Sequence
  derived and/or modified sequence opt5 from VP1__Norovirus__BAJ13900
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacgucgcccugcuuagauuugugaacccugauaccggacgcgugcuguucgaguguaaacuccacaaguccggcuacguuacagucgcucauaccgggcagcacgaccuggugauucccccgaacggcuauuuucgguucgauagcugggugaaucaauuuuacacgcuugccccuaugggaaacggcaccgggagacgccgggcggucuga

SEQ ID NO: 27637 - RNA, 1623 nt, Artificial Sequence; identical to SEQ ID NO: 27629
  derived and/or modified sequence opt5 from VP1__Norovirus__BAJ13903

SEQ ID NO: 27638 - RNA, 1623 nt, Artificial Sequence; identical to SEQ ID NO: 27636
  derived and/or modified sequence opt5 from VP1__Norovirus__BAJ13906

SEQ ID NO: 27639 - RNA, 1623 nt, Artificial Sequence
  derived and/or modified sequence opt5 from VP1__Norovirus__BAJ13909
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucaccggcagcagaaauuacaccaugaaccucgcuucucugaauuggaacaauuaugauccuacagaggaaauucccgcgccucuuggcacgcccgacuucguggggaaaauccagggaguccugacccagacaaccaagggcgacggguccacacggggacacaaggccaccguguacacgggcagcgcugauuuuacaccgaaacucggguccguucaguucgccaccgacaccgagaacgauuuugaaacacaucaaaauaccaaguucacaccugugggagucauucaggacggcggcacgacccaccgcaacgagccccagcaaugggugcugcccucuuacagcgggagaaauguucacaacgugcaucuugccccugcugucgccccgaauuuucccggagaacagcuccuguucuuucgguccacaaugccuggcuguagcggguaucccaacauggaucuggacugccugcucccucaggagugggugcagcacuucuaccaagaggcggcucccgcccagucugauguggcccugcuucgcuuuguuaacccugacaccggaagaguccuguucgaauguaaacuccauaaguccggcuaugugacaguggcucacaccgggcagcacgaucuggucauucccccgaauggcuacuuucgguucgacagcugggugaaccaguucuauacgcuugccccuaugggaaauggcaccgggagacgccgggcucuguga

SEQ ID NO: 27640 - RNA, 1623 nt, Artificial Sequence; identical to SEQ ID NO: 26802
  derived and/or modified sequence opt5 from VP1__Norovirus__BAJ13912

SEQ ID NO: 27641 - RNA, 1623 nt, Artificial Sequence; identical to SEQ ID NO: 27567
  derived and/or modified sequence opt5 from VP1__Norovirus__BAJ13918

SEQ ID NO: 27642 - RNA, 1623 nt, Artificial Sequence
  derived and/or modified sequence opt5 from VP1__Norovirus__BAJ13924
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguucagaaugugcaccuugccccggcugucgcccccaccuuuccuggagagcagcuccuguucuuucggucuacaaugcccggcuguuccggguauccuaacauggaucuggacugccugcucccccaggagugggugcaacauuucuaccaggaagcggcuccugcccagagcgauguggcccugcuucgcuuuguuaaucccgacaccggaagaguccuguucgaguguaaacuccacaagucuggcuaugugacaguggcucauaccgggcagcacgaucuggucaucccgccuaacggcuacuuucgguucgacagcugggugaaccaauucuauacgcuugcccccaugggaaauggcaccgggagacgccgggcucuguga

SEQ ID NO: 27643 - RNA, 1623 nt, Artificial Sequence
  derived and/or modified sequence opt5 from VP1__Norovirus__BAJ13927
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacagggggagccccguuuacgccuaaacucggcuccgcccaguucagcaccgacaccgaaaacgauuuugagacacaucagaauaccaaguucacacccguuggcgugauucaagacgggggaacgacccaccgcaacgaaccccagcaguggguccugccuuccuacucuggcagaaaugugcacaacguucaucuugcuccggccguggcgcccacauuuccuggggagcaacuccuguucuuucggagcaccaugcccggauguuccggcuauccuaauauggaucuggacugccugcucccccaggaguggguccagcacuucuaccaggaagcugccccugcccaaagcgauguggcucugcuucgcuuugugaaccccgacacagggagaguucuguucgaguguaaacuccauaagucuggcuaugucaccguggcccacacgggacagcacgaucuggugaucccgccuaacggcuacuuucgguucgacuccugggucaaucaguucuauacccuugcucccauggggaacggaacaggcagacgccgggcccuguga

SEQ ID NO: 27644 - RNA, 1623 nt, Artificial Sequence
  derived and/or modified sequence opt5 from VP1__Norovirus__BAJ13930
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuugauccggaccugaaucccuaccucucucagcuggcucgcauguauaacggcuacgccgggggauucgaaguccaggugauccuugcuggcaaugccuuuacagcgggcaaaauuaucuucgccgcuguuccucccaacuuuccuacggaggggcugagccccucccaagugaccauguucccgcacaucauugucgaugugagacagcucgagccugugcugaucccccugccugacguccggaauaacuuuuaucauuacaaucagucuaacgauagcacaauuaagcucaucgccaugcuguauacaccccuucgcgcuaacaaugccggagaagacguuuucaccguguccugcagagugcugacccggcccagcccugauuuugacuucauuuuucucgucccgcccacaguggagucucgcaccaaaccuuucacgguucccauccugaccguggaagagaugacaaacuccagauuuccuauuccccuugagaagcuguucaccggcccgagcucugccuucgucgugcagccucaaaaugggcgguguacaaccgauggaguucuccugggcacgacacagcugucccccgugaacaucugcaccuuucgcggggacgucacacacaucgcuggaagcagaaauuacaccaugaaccucgcgucucugaauuggaacaauuaugauccuaccgaagagauucccgccccucuuggcacacccgacuucgugggcaaaauccaggggguccugacgcagaccacaaagggagacggcuccacccgggggcauaaggcuacaguguacaccggaagcgccccguuuacgccuaaacucggcuccguucaauucucuacagauaccgaaaacgacuuugagacccaccagaauacaaaguucacccccgugggggucauucaggauggaggcacaacgcaucgcaacgaaccccaacagugggugcugccuagcuacuccggcagaaauguuccgaacgugcaccuugcccccgcugucgccccuaccuuucccggggagcagcuccuguucuuucggagcacaaugccuggauguucuggcuaucccaauauggaccuggauugccugcucccucaggagugggugcaacacuucuaccaggaagcggcucccgcccaguccgacguggcccugcuucgcuuuguuaacccggauaccgggagaguccuguucgaguguaaacuccauaagagcggauaugugacaguggcucacaccggccagcaugaccuggucaucccucccaacggguacuuucgguucgauucuugggugaaucaauucuauacgcuugccccuaugggcaacggaaccggcagacgccgggcucuguga

SEQ ID NO: 27645 - RNA, 1623 nt, Artificial Sequence; identical to SEQ ID NO: 26945
  derived and/or modified sequence opt5 from VP1__Norovirus__BAJ13933

SEQ ID NO: 27646 - RNA, 1623 nt, Artificial Sequence; identical to SEQ ID NO: 26802
  derived and/or modified sequence opt5 from VP1__Norovirus__BAJ13936

SEQ ID NO: 27647 - RNA, 1623 nt, Artificial Sequence; identical to SEQ ID NO: 27081
  derived and/or modified sequence opt5 from VP1__Norovirus__BAJ13939

SEQ ID NO: 27648 - RNA, 1623 nt, Artificial Sequence
  derived and/or modified sequence opt5 from VP1__Norovirus__BAJ13942
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagagacuacaccaugaaucucgcgagccugaacuggaauaacuaugauccuacagaagagauucccgccccucuugggacgcccgacuucgugggaaaaauccaaggcguccugacccagacaaccaagggggacggaucuacacggggccacaaggcuaccguguacacgggguccgccccguuuacaccuaaacucggaagcguucaguucuccaccgauaccgaaaaugacuuugagacacaucagaacaccaaguucacacccgugggcgucauucaagauggcgggacgacccaccgcaaugaaccccagcagugggugcugccuucuuacagcggaagaaacguucacaaugugcaucuugccccggcugucgcccccacauuuccuggcgagcaacuccuguucuuucgguccaccaugcccggguguagcggauauccuaacauggaccuggauugccugcucccccaggagugggugcagcacuucuaccaggaagcggcuccugcccaaucugacguggcccugcuucgcuuuguuaaucccgauacaggcagaguccuguucgaguguaaacuccauaaguccggguaugugaccguggcucacacgggccagcacgaccuggucaucccgccuaacggauacuuucgguucgauagcugggugaaccaguucuauacccuugcccccaugggcaaugggacaggaagacgccgggcucuguga

SEQ ID NO: 27649 - RNA, 1623 nt, Artificial Sequence; identical to SEQ ID NO: 27607
  derived and/or modified sequence opt5 from VP1__Norovirus__BAJ13945

SEQ ID NO: 27650 - RNA, 1623 nt, Artificial Sequence
  derived and/or modified sequence opt5 from VP1__Norovirus__BAJ13948
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcaacacaacgcaccgcaaugaaccccagcaaugggugcugccuagcuacuccggcagaaacguucagaaugugcaccuugccccggcugucgcccccaccuuuccuggggagcagcuccuguucuuucggagcacaaugcccggauguucuggcuauccuaacauggaucuggacugccugcucccccaggagugggugcaacauuucuaccaggaagcggcuccugcccaguccgauguggcccugcuucgcuuuguuaaccccgacaccgggagaguccuguucgaguguaaacuccacaagagcggauaugugacaguggcucauaccggccagcacgaucuggucaucccgccuaauggguacuuucgguucgacucuugggugaaccaauucuauacgcuugcccccaugggcaauggaaccggcagacgccgggcucuguga

SEQ ID NO: 27651 - RNA, 1623 nt, Artificial Sequence; identical to SEQ ID NO: 26945
  derived and/or modified sequence opt5 from VP1__Norovirus__BAJ13951

SEQ ID NO: 27652 - RNA, 1623 nt, Artificial Sequence
  derived and/or modified sequence opt5 from VP1__Norovirus__BAJ13954
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcaacacaacgcaccgcaaugaaccccagcaauggguccugccuagcuacuccggcagaaacgugcagaauguucaccuugccccggcuguggcccccaccuuuccuggggagcagcuccuguucuuucggagcacaaugcccggauguucuggcuauccuaacauggaucuggacugccugcucccccaggaguggguccaacauuucuaccaggaagcggcuccugcccaguccgauguggcccugcuucgcuuugugaaccccgacaccgggagaguucuguucgaguguaaacuccacaagagcggauaugucacaguggcucauaccggccagcacgaucuggugaucccgccuaauggguacuuucgguucgacucuugggucaaccaauucuauacgcuugcccccaugggcaauggaaccggcagacgccgggcucuguga

SEQ ID NO: 27653 - RNA, 1623 nt, Artificial Sequence
  derived and/or modified sequence opt5 from VP1__Norovirus__BAJ13957
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccuucuggcccggaucuuaaucccuaccugagccaccucgcucgcauguucaacgacuaugccgggggauuugaaguccaggugauccuggcuggcaaugccuucacggcgggcaaaauuaucuuugccgcuguuccucccaacuucccuaccgaggggcuuucccccucucaggugacaauguuuccgcauaucauugucgaugugagacagcuggagccugugcucaucccccugccugacguccggaauaacuucuaccacuauaaucaaagcaacgauuccaccauuaagcugaucgccaugcucuacacaccccugcgcgcuaacaaugccggagaagacguuuuuaccgugagcugcagagugcuuacacggcccucuccugauuucgacuuuauuuuccuggucccgcccaccguggagucccgcacgaaaccuuuuaccguucccauccucacaguggaagagaugaccaacagcagauucccuauuccccuggagaaacuuuucacaggcccgucuggggccuuugucgugcagccucagaauggacgguguaccacggauggcguucugcucgggacaacccagcugucccccgugaacaucugcacauuccgcggagacgucacccauaucgcuggcagcagaaauuauaccaugaaccuggcgucucucaauuggaacaauuacgauccuacagaagagauucccgccccucugggcacgcccgacuuuguggggaagauccaaggaguccuuacccagacaaccaagggcgacggguccacacggggacacaaggcuaccguguauacgggcagcgccccguucacaccuaaacugggguccguucaguuuucuaccgauaccgaaaacgacuucgaggcccaucagaauacaaaguuuacccccgugggagucauucaagauggcagcacaacgcaccgcaacgaaccccagcagugggugcucccuuccuacagcggcagaaauguucaaaacgugcaccuggcuccggccgucgcgcccaccuucccuggggagcagcuucuguuuuuccggucuacaaugcccggauguuccggcuacccuaauauggaccucgauugccugcugccccaggagugggugcagcauuuuuaucaagaagcugccccugcccagagcgacguggcucuccugcgcuucguuaaccccgauaccgggagaguccuuuuugaguguaaacugcacaagucuggauacgugacaguggcccauaccggccagcacgaccucgucaucccgccuaacggguauuuccgguucgauagcugggugaaucaguuuuacacgcuggcucccaugggcaacggaaccggcagacgccgggcccuuuga

SEQ ID NO: 27654 - RNA, 1623 nt, Artificial Sequence; identical to SEQ ID NO: 27081
  derived and/or modified sequence opt5 from VP1__Norovirus__BAJ13960

SEQ ID NO: 27655 - RNA, 1623 nt, Artificial Sequence; identical to SEQ ID NO: 27081
  derived and/or modified sequence opt5 from VP1__Norovirus__BAJ13963

SEQ ID NO: 27656 - RNA, 1623 nt, Artificial Sequence; identical to SEQ ID NO: 27567
  derived and/or modified sequence opt5 from VP1__Norovirus__BAJ13966

SEQ ID NO: 27657 - RNA, 1623 nt, Artificial Sequence; identical to SEQ ID NO: 26802
  derived and/or modified sequence opt5 from VP1__Norovirus__BAJ13969

SEQ ID NO: 27658 - RNA, 1623 nt, Artificial Sequence
  derived and/or modified sequence opt5 from VP1__Norovirus__BAJ13972
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagagacuacaccaugaaucucgcgagccugaacuggaauaacuaugauccuaccgaagagauucccgccccucuugggacacccgacuucgugggaaaaauccagggcguccugacgcagaccacaaagggggacggaucuacccggggccacaaggcuacaguguacaccggguccguuccguuuacgccuaaacucggaagcgugcaguucuccacagauaccgaaaaugacuuugagacccaucaaaacacaaaguucacccccgucggcgugauucaggauggcucuacaacgcaccgcaaugaaccccagcaauggguucugccuagcuacuccgggagaaacgugcacaauguccaucuugccccggccguggcucccaccuuuccuggagagcagcuccuguucuuucggagcacaaugcccggcuguucuggguauccuaacauggaccuggauugccugcucccccaggagugggugcagcacuucuaccaagaagccgcgccugcucaguccgacguugcccugcuucgcuuugucaaucccgauaccggaagagugcuguucgaguguaaacuccauaagagcggcuaugugacagucgcccacaccgggcagcacgaccuggugaucccgccuaacggcuacuuucgguucgauucuuggguuaaccaguucuauacgcuugcucccaugggaaauggcaccgggagacgccgggcccuguga

SEQ ID NO: 27659 - RNA, 1623 nt, Artificial Sequence
  derived and/or modified sequence opt5 from VP1__Norovirus__BAJ13975
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcggcacaacgcaccgcaacgagccccagcaaugggugcugcccucuuacagcgggagaaauguucacaacgugcaucuugcuccugccgucgcgccgaauuuucccggagaacagcuccuguucuuucgguccaccaugccuggcuguagcggguaucccaacauggaucuggacugccugcucccucaggagugggugcagcacuucuaccaagaggcugcccccgcccagucugauguggcucugcuucgcuuuguuaacccugacacaggaagaguccuguucgaauguaaacuccauaaguccggcuaugugaccguggcccacacagggcagcacgaucuggucauucccccgaauggcuacuuucgguucgacagcugggugaaccaguucuauacccuugcuccuaugggaaauggcacggggagacgccgggcccuguga

SEQ ID NO: 27660 - RNA, 1623 nt, Artificial Sequence
  derived and/or modified sequence opt5 from VP1__Norovirus__BAJ13978
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccacgccguuuacaccuaaacucggaagcguucaguucuccaccgacaccgaaaacgauuuugagacacaucaaaauaccaaguucacacccgugggcgucauucaggacggcucuacgauccaccgcaacgaaccccagcaaugggugcugccuagcuacuccgggagaaauguucagaacgugcaccuugccccggccgucgcucccaccuuuccuggagagcagcuccuguucuuucggagcacaaugcccggcuguucuggguauccuaauauggaucuggacugccugcucccccaggagugggugcaacauuucuaccaggaagccgcgccugcucaguccgauguggcccugcuucgcuuuguuaaccccgacaccggaagaguccuguucgaguguaaacuccacaagagcggcuaugugacaguggcccauaccgggcagcacgaucuggucauuccgccuaacggcuacuuucgguucgacucuugggugaaucaauucuauacgcuugcucccaugggaaacggcaccgggagacgccgggcccuguga

SEQ ID NO: 27661 - RNA, 1623 nt, Artificial Sequence; identical to SEQ ID NO: 27081
  derived and/or modified sequence opt5 from VP1__Norovirus__BAJ13981

SEQ ID NO: 27662 - RNA, 1623 nt, Artificial Sequence; identical to SEQ ID NO: 26802
  derived and/or modified sequence opt5 from VP1__Norovirus__BAJ13984

SEQ ID NO: 27663 - RNA, 1623 nt, Artificial Sequence; identical to SEQ ID NO: 26802
  derived and/or modified sequence opt5 from VP1__Norovirus__BAJ13987

SEQ ID NO: 27664 - RNA, 1623 nt, Artificial Sequence
  derived and/or modified sequence opt5 from VP1__Norovirus__BAJ13990
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgggcucuguga

SEQ ID NO: 27665 - RNA, 1623 nt, Artificial Sequence; identical to SEQ ID NO: 26802
  derived and/or modified sequence opt5 from VP1__Norovirus__BAJ13993

SEQ ID NO: 27666 - RNA, 1623 nt, Artificial Sequence; identical to SEQ ID NO: 27607
  derived and/or modified sequence opt5 from VP1__Norovirus__BAJ13996

SEQ ID NO: 27667 - RNA, 1623 nt, Artificial Sequence; identical to SEQ ID NO: 27544
  derived and/or modified sequence opt5 from VP1__Norovirus__BAJ13999

SEQ ID NO: 27668 - RNA, 1623 nt, Artificial Sequence; identical to SEQ ID NO: 27607
  derived and/or modified sequence opt5 from VP1__Norovirus__BAJ14002

SEQ ID NO: 27669 - RNA, 1623 nt, Artificial Sequence
  derived and/or modified sequence opt5 from VP1__Norovirus__BAJ14005
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucugauccuuaccguggaagagaugacaaacuccagauuucccauuccucuggagaaacucuucaccgggcccagcucugccuucgucgugcagccgcagaauggacgguguacaaccgacggcguucugcuggggacgacacaacucuccccugugaacaucugcaccuuucgcggagaugucacacauaucgcuggcagcagaaauuacaccaugaaccuggcgucucuuaauuggaacaauuaugaccccaccgaagagauuccugcuccccugggcacaccugauuucguggggaagauccagggaguccucacgcagaccacaaagggcgacggguccacccggggacacaaggccacaguguacaccggcagcgcccccuuuacgccgaaacugggguccguucaguucucuacagacaccgaaaacgauuuugagauucaucaaaauaccaaguucacaccugugggagucauccaggacggcagcaccacacaccgcaacgaaccccagcaaugggugcuucccuccuacagcggcagaaauguucacaacgugcaucuggccccugcugucgccccgacguuucccggggagcagcuccuguucuuucggucuaccaugccuggauguuccggcuaucccaauauggaucuggacugccuccugccucaggagugggugcagcacuucuaccaagaagcggcucccgcccagagcgauguggcccuucugcgcuuuguuaacccugacacagggagaguccucuucgaguguaaacugcauaagucuggauaugugaccguggcuuacacaggccagcacgaucuugucauucccccgaacggguauuuucgguucgacagcugggugaaucaguucuacacccuggccccuaugggcaacggaacgggcagacgccgggcucucuga

SEQ ID NO: 27670 - RNA, 1623 nt, Artificial Sequence
  derived and/or modified sequence opt5 from VP1__Norovirus__BAJ14008
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccgugcugacagucgaagagaugaccaacuccagauuuccuaucccccuugagaagcuguucacagggccgagcggagccuucgugguucagccucagaauggccgguguaccacggacggggugcuccugggaacaacccagcugucucccgucaacauuugcacauuucgcggcgaugugacccauaucgcuggcuccagaaauuacaccaugaaccucgcgagccugaauuggaacaauuaugacccuacagaagagauccccgccccucuugggacgcccgauuucgucggaaaaauucaaggcgugcugacccagacaaccaagggggacggaucuacacggggccacaaggcuaccguuuacacgggguccgccccguuuacaccuaaacucggaagcgugcaguucuccaccgacaccgaaaacgauuuugagacacaucagaauaccaaguucacacccgucggcgugauccaagacggcucuacgacccaccgcaacgaaccccagcaguggguucugccuagcuacuccgggagaaaugugcacaacguccaucuugccccggcuguggcccccacauuuccuggagagcaacuccuguucuuucggagcaccaugcccggcuguucuggguauccuaauauggaucuggacugccugcucccccaggagugggugcagcacuucuaccaggaagcggcuccugcccaauccgagguugcccugcuucgcuuugucaaccccgauacaggaagagugcuguucgaauguaaacuccauaagagcggcuaugugaccgucgcucacacggggcagcacgaccuggugauuccgccuaacggcuacuuucgguucgauucuuggguuaaucaguucuauacccuugcccccaugggaaacggcacagggagacgccgggcucuguga

SEQ ID NO: 27671 - RNA, 1623 nt, Artificial Sequence
  derived and/or modified sequence opt5 from VP1__Norovirus__BAJ14011
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagauucaucaaaauaccaaguucacacccgugggagucauccaggacggcagcaccacacaccgcaacgaaccccagcaaugggugcugccuuccuacagcggcagaaauguucacaacgugcaucuugccccggcugucgcccccacguuuccuggggagcagcuccuguucuuucggucuaccaugcccggauguuccggcuauccuaauauggaucuggacugccugcucccccaggagugggugcagcacuucuaccaagaagcggcuccugcccagagcgauguggcccugcuucgcuuuguuaaccccgacacagggagaguccuguucgaguguaaacuccauaagucuggauaugugaccguggcuuacacaggccagcacgaucuggucauuccgccuaacggguauuuucgguucgacagcugggugaaucaguucuacacccuugcccccaugggcaacggaacgggcagacgccgggcucuguga

SEQ ID NO: 27672 - RNA, 1623 nt, Artificial Sequence; identical to SEQ ID NO: 26802
  derived and/or modified sequence opt5 from VP1__Norovirus__BAJ14014

SEQ ID NO: 27673 - RNA, 1623 nt, Artificial Sequence
  derived and/or modified sequence opt5 from VP1__Norovirus__BAK43269
auggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgccuguauaauggguacgccggaggcauggagguucaggugaugcuggcgggcaacgccuucacagcugggaagcucgucuuucccgccgugccuccccauuucccuauugaaaaucugucuccccagcagaucaccauguuuccgcacguuauuaucgaugugagaacacuugagccuguccugcucccccugccugacgugcggaacaauuucuuucauuauaaccaaaaagaugaccccaagaugcgcaucguggcuaugcuuuacacaccccugagauccaauggaagcggcgaugacgucuucaccguuuccugccgggugcucacccgcccuucuccggauuuugacuucacguaucuggugcccccuaccgucgaaagcaaaacaaagcccuuuacccugccuauucucacacugggggagcuuuccaacagcagauuccccgugucuaucgaucagauguacaccuccccgaacgagguuauuagcgugcagugucagaauggacggugcacgcuggacggcgaacuccaagggacaacccagcugcaggucucuggaaucugugccuuuaaaggcgaggugacagcccaccuucaugauaacgaccaccuguauaauauuaccaucaccaaccucaauggcuccccuuucgaccccagcgaagauauuccugcuccccuggggguuccugacuuccagggacgcguguuuggcaucaucucucaaagagauaagcacaacucccccgggcauaaugagccggcgaaccggggacacgacgccgucgugccuacauacacggcucaguacacccccaagcugggccagauucaaaucgggacauggcagaccgaugaccucacagucagccagcccgugaaauucaccccuguuggacugaaugauauugaacauuuuaaccaguggguggucccgcgcuaugccggcgcccuuaaucugaacacgaaucucgcucccuccguggccccuguuuuccccggcgagagacugcuguuuuuccggucuuacaucccucuuaaagggggauauggcaaccccgcgauugacugccuccugccucaagagugggugcagcacuuuuaccaggaagcugcccccagcauguccgaggucgcccuggugcgcuauaucaauccggauacagggagagcucucuucgaagccaagcugcaccgggcuggauuuaugaccgugagcucuaacaccuccgccccuguugucgugcccgcgaacggcuacuucagauuugacagcugggugaaucaguucuauucucuugccccuauggggacaggcaacggacgccggagaguccaauga

SEQ ID NO: 27674 - RNA, 1623 nt, Artificial Sequence
  derived and/or modified sequence opt5 from VP1__Norovirus__BAK43272
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacacccaaaacgauuuugaaacccaucagaauacaaaguucacccccgugggagucauucaggacggcggcacaacgcaccgcaacgagccccaacagugggugcugccuagcuacuccgggagaaauguuccgaacgugcaccuugcccccgcugucgccccuaccuuucccggagaacagcuccuguucuuucggagcacaaugccuggcuguucuggguaucccaauauggaucuggacugccugcucccucaggagugggugcaacauuucuaccaggaggcggcucccgcccaguccgauguggcccugcuucgcuuuguuaacccggacaccggaagaguccuguucgaauguaaacuccacaagagccgguaugugacaguggcucauaccggccagcacgaucuggucaucccucccaacggguacuuuagauucgacucuugggugaaucaauucuauacgcuugccccuaugggcaacggaaccggccgccggagagcucuguga

SEQ ID NO: 27675 - RNA, 1647 nt, Artificial Sequence
  derived and/or modified sequence opt5 from VP1__Norovirus__BAK43275
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuugucgccaugcuguacacaccccucagagcuaauaacuccggggaugacguguucaccgugucuugucggguccugacacgcccuagccccgauuuuuccuucaauuuucuuguucccccuaccguggagagcaagacaaaaccguucacccugcccauucucacgaucucugaaauguccaacagcagauuuccugugcccauugacucucugcauaccuccccuacagagaauaucgucgugcagugccagaacggacggguuacccuggauggcgagcucauggggacaacccaacugcuucccagccagaucugugcguuccgcggagugcugacgagaucuacaucccgggccagcgaccaggcugauaccgccacaccgcgccucuucaauuauuacuggcacauucagcuggccaaccuuaauggcaccccuuaugaccccgcugaagacaucccuggcccccuggggaccccugauuuuagaggaaaggucuucggcguggccugccaacggaaccccgacuguacaacgcgcgcgcaugaggcuaaaguugauaccacagccgggagauuuaccccgaagcucggaucccuggaaauuucuacagagagcggcgacuucgaucagaaucagccuacccgguuuacgcccguggggaucggagucgaccacgaagccgauuuccaacaguggucccugcccgacuacagcggccaguuuacacacaacaugaaucucgcuccugccguggcuccgaacuuccccggcgagcagcugcuguuuuucagaucucaacuuccuuccagcgggggacgcucuaauggcauucucgauugccuggucccccaggagugggugcagcauuuuuaccaggaaagcgccccugcgcaaacccagguugcccuugugcgguaugucaaccccgacaccgggagagugcuguucgaggcuaagcuccacaaacugggauuuaugacaaucgccaagaacggcgauuccccuaucaccguucccccgaauggguacuuccgcuucgaaucuugggugaacccuuuuuauacacuggcucccaugggcacgggaaauggccggagacgcauucaguga

SEQ ID NO: 27676 - RNA, 1623 nt, Artificial Sequence
  derived and/or modified sequence opt5 from VP1__Norovirus__BAK43278
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauacccauaacgugcaccuggcccccgccgucgcuccuacauuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccucuuacgugaccguggcccauacggggcagcacgaucucgucauuccucccaacggauauuuucgcuucgacagcugggugaaucaauucuacacccuggcuccuaugggcaacgggacaggccggagacaugcccuuuga

SEQ ID NO: 27677 - RNA, 1623 nt, Artificial Sequence
  derived and/or modified sequence opt5 from VP1__Norovirus__BAK43284
auggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaagcuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaagaugacccuaagaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaaaacaaagccuuuuacccugcccauccugacacucggggagcugagcaauucuagauucaccguuuccauugaucagauguacacgagccuuaacgaggugaucucuguccagugucagaacggacggugcacacuggacggcgaacuccgcgggaccacacaacuucagguguccggaauuugugccuuuaaaggcgagguuaccgcucacgugcaugauaaugaccaccuguauaacgucaccaucacaaaucugaacggcagcccuuucgaccccucugaagaugugccggcgccucucgggguccccgacuuccagggaagaguguuuggcauuaucucccagcgggauaagcacaauagcccugggcauaacgagcccgccaaucgcggacacgacgcuguugugccuacguacaccgcccaauacacacccaagcugggccagauucagaucgggaccuggcaaacagaugaccugaccgucaaccagccggugaaauucacgccuguuggacucaaugauacagaacauuuuaaccagugggugguccccagauaugccggcgcucugaaucuuaacaccaaucuggcccccuccguggcgccuguguucccgggcgagcggcuccuguuuuuccgcucuuacguuccccuuaaagggggauauggcaacccugcuaucgacugccugcucccccaggaguggguccaacacuuuuaccaggaagccgccccuagcauguccgagguggcucuggugagauauauuaaucccgauaccgggcgggcccuguucgaagcuaagcuccacagagccggauuuaugacagucagcucuaacaccuccgcgccugugguugugcccgccaacggcuacuuccgcuuugacagcugggucaaucaguucuauucucuggcuccgauggggacaggcaacggacggagacgcgugcaguga

SEQ ID NO: 27678 - RNA, 1644 nt, Artificial Sequence
  derived and/or modified sequence opt5 from VP1__Norovirus__BAL14785
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccuagaaauucccccggggaaaugcugcuuaaccuggagcucggaccugagcugaauccguaccuuucucaccugagccgcauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaagggacgguguucggagucgcuucucagagagacguguccggccagcagguuggggccacccgggcccacgaagugcacaucagcacaaccgaucccagauauacaccgaagcugggauccauucugaugcgcucugagagcgacgauuuugucaccggccaaccugugcgguucacgcccaucgggaugggagacaacgauuggcaucagugggagcuccccgacuacuccggccaccugacacuuaauaugaaccuggcuccugccguugcgccggcuuuucccggcgaacggauucucuucuuucgcagcauggugccuucugccgggggauacggcuccgggcagaucgauugccugauuccccaggaguggguccaacauuucuaucaggaagccgcuccuagccagucugccguggcucuuauccgguacgugaaucccgacaccggaagaaacaucuuugaggccaagcugcaccgcgaaggcuucauuaccguugcgaauagcgggaacaauccuaucgucgugcccccgaacggcuauuuucgguucgaggccugggugaaucaguuuuacacacucaccccuaugggaacaggccaagggagacgccggaaccaguga

SEQ ID NO: 27679 - RNA, 1749 nt, Artificial Sequence
  derived and/or modified sequence opt5 from VP1__Norovirus__BAR88157
augaagauggccagcuccgacgcugccucucccagcuccgauggcgcggcuaaccuggugccugagaucaauaacgaagucauggcccucgagccgguugccggggcucagcuggccgcucccguggccgaccaauucaaugcgauugauccuuggaucagacagaacuuugugcaggcccccgaaggagaguucaccgucucuccucggaaugcucccggcgaaauucuucugaaccucgagcuggggccucaccuuaauccguuucugcagcaucucgcccaaauguacaacgcuuaugccggaggcauggaggugcagguugugcuggcggggaaugccuucacagcuggaaagaucauuuuugccgcuauucccccucacuuucccccugaacgccugagcgccgcccaggcuacgcaguucccccaugucaucaucgacgugagacaacucgagccgaucguucugccucuucccgaugugcggcacaaccuguuccauuuuaaucagcagaacgacgaacgcaugagacucgucgcguuccuguacaccccucuucgggccaauuccggcucuggcgaugacguguuuacagugagcugccgcguccugaccagacccucccccgauuucgaguuuauguuccucguuccuccgacaguggagcggaagaccguggcuuucagccugccccagcugacagucggggaaaugucuaacucccgcuggccugccagaauuaccacgaugaucgccgacccccaccucccucaagugcugcggauucagaauggacgcuguacccuugauggcacacugauggggaccacacagcucaaccccaacgacaucugcagaguucggggauauuuuagcaauucucgcccgcaagugaugugugagggcgaagaugacgcucuggaccaggccucccuuggggcggagccuauuagagaucaggcucccggacugcggacccaggccagaagcacggaacgcugguucgccgucacagagcucaacggccaggcuuacgacccuuuuggcgaucaacccgccccucugggggugcccgacuucgaggcucggaucguuggagcccuggugagacucccgggcaccaauccuacaucuaacucccgcuuugaagaugcguggaucgacaccaauaaccagaccacauaugcccccgcugccgggauggucgcuauuacgaccagcgaugacuccucuagcaauuacgccaacgaucaggugugcgaguuccugccccuuggagucgacaucacaaauuccaccccuuauaacgaauuugaucugccgagcuacggcgggucugcguccagcggaaaucggaaccucgcccccacaguggcuccuaccuuccccggcgagauuguucugcuuuuuggcucuaauaugccugugcaaaacagaagcgccgggacguccaauaaagaaauccgcugucugcuccccaacgaguacauucagcaccuguaugacacacaggcuccuucucugagcgacgucgcccucgugcgguacaucaaccccgauaccggaagaguucuguucgaggccaaacuucaucgcgacggcuuuaugaccgugaaugcuuccgcgacaaccguccugccgguggaugggcacuuccgguuugacagcugggugaaccaguucuaugcccucucuccuguuggaaaugcuuccggcagacgcgggcggaacagacgggucgauuga

SEQ ID NO: 27680 - RNA, 1623 nt, Artificial Sequence; identical to SEQ ID NO: 27081
  derived and/or modified sequence opt5 from VP1__Norovirus__BAS29993

SEQ ID NO: 27681 - RNA, 1623 nt, Artificial Sequence
  derived and/or modified sequence opt5 from VP1__Norovirus__BAS29996
augaagauggccagcaacgacgcuacccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcucugccuucgucgugcagccucagaacggacgguguaccacggacggcguucuccuggggacaacccaacugucccccgugaauaucugcacauuucgcggagaugucacccauaucgcuggcagcagaaacuacaccaugaaucucgcgucucugaacuggaauaacuaugacccuacagaagagauucccgccccucuuggcacgcccgauuucguggggaaaauccagggaguccugacccagacaaccaagggcgacggguccacacggggacacaaggcuaccguguacacgggcagcgccccguuuacaccuaaacucggguccguucaguucucuaccgacaccgaaaaugauuuugagacacaucaaaacaccaaguucacacccgugggagucauucaggacggcggcacgacccaccgcaaugaaccccagcaaugggugcugccuagcuacuccgggagaaacguuccgaaugugcaccuugcccccgcugucgccccuacauuucccggagagcagcuccuguucuuucggagcaccaugccuggcuguucuggguaucccaacauggaucuggacugccugcucccucaggagugggugcagcauuucuaccaagaagcggcucccgcccaguccgauguggcccugcuucgcuuuguuaauccggacacaggaagaguccuguucgaguguaaacuccacaagagcggcuaugugaccguggcucauacggggcagcacgaucuggucaucccucccaacggcuacuuucgguucgacucuugggugaaccaguucuauacccuugccccuaugggaaauggcacagggagacgccgggcucuguga

SEQ ID NO: 27682 - RNA, 1623 nt, Artificial Sequence
  derived and/or modified sequence opt5 from VP1__Norovirus__BAS29999
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgaaaaugacuuugagacccaucaaaacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgagguggcccugcuucgcuuuguuaauccggacaccggaagaguccuguucgaauguaaacuccacaagagcggcuaugugacaguggcucauaccgggcagcacgaucuggucaucccucccaacggcuacuuucgguucgacucuugggugaaccaguucuauacgcuugccccuaugggaaauggcaccgggagacgccgggcucuguga

SEQ ID NO: 27683 - RNA, 1623 nt, Artificial Sequence
  derived and/or modified sequence opt5 from VP1__Norovirus__BAS30005
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugagacccaucaaaacacaaaguucacccccgugggcgucauucaggacggcagcacaacgcaccgcaaugaaccccagcaaugggugcugccuuccuacagcgggagagauguucacaacgugcaucuugccccggcugucgcccccaccuuuccuggagagcagcuccuguucuuucggucuacaaugcccggcuguuccggguauccuaauauggaccuggauugccugcucccccaggagugggugcagcacuucuaccaagaagcggcuccugcccagagcgacguggcccugcuucgcuuuguuaaccccgauaccggaagaguccuguucgaguguaaacuccauaagucuggcuaugugacaguggcucacaccgggcagcacgaccuggucaucccgccuaauggcuacuuucgguucgauagcugggugaaccaguucuauacgcuugcccccaugggaaacggcaccgggagacgccgggcucuguga

SEQ ID NO: 27684 - RNA, 1623 nt, Artificial Sequence
  derived and/or modified sequence opt5 from VP1__Norovirus__BAS30008
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacggcggggaaaauuaucuucgccgcuguuccucccaacuuuccuaccgagggacugagccccucccaggugacaauguucccgcauaucauugucgacgugagacagcucgagccugugcugaucccccugccugauguccggaauaacuuuuaucacuacaaucaaucuaacgacagcaccauuaagcucaucgccaugcuguauacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccauaucgcuggcuccagaaauuacaccaugaaccucgcgagccugaauuggaacaauuaugacccuacagaagagauucccgccccucuugggacgcccgauuucgugggaaaaauccaaggcguccugacccagacaaccaagggggacggaucuacacggggccacaaggcuaccguguacacgggguccgccccguuuacaccuaaacucggaagcguucaguucuccaccgacaccgaaaacgauuuugaggcccaucagaauacaaaguucacccccgugggcgucauucaagacggcucuacaacgcaccgcaacgaaccccagcagugggugcugccuagcuacuccgggggaaauguucaaaacgugcaccuugcuccggccgucgcgcccaccuuuccuggcgagcagcuccuguucuuuagaagcacaaugcccggguguucuggauauccuaauauggaucuggacugccugcucccccaggagugggugcagcauuucuaccaagaagcugccccugcccaguccgauguggcucugcuucgguuuguuaaccccgacaccggccgcguccuguucgaguguaaacuccacaagagcggguaugugacaguggcccauaccggccagcacgaucuggucaucccgccuaacggauacuuuagauucgacucuugggugaaucaguucuauacgcuugcucccaugggcaacgggaccggacggagacgcgcccuguga

SEQ ID NO: 27685 - RNA, 1623 nt, Artificial Sequence; identical to SEQ ID NO: 27532
  derived and/or modified sequence opt5 from VP1__Norovirus__BAS30011

SEQ ID NO: 27686 - RNA, 1623 nt, Artificial Sequence
  derived and/or modified sequence opt5 from VP1__Norovirus__BAS30014
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaucuuucccggagagcagcuccuguucuuucggagcaccaugccuggcuguucuggguaucccaauauggaucuggacugccugcucccucaggagugggugcagcauuucuaccaagaagcggcucccgcccaguccgauguggcccugcuucgcuuuguuaacccggacacaggaagaguccuguucgaguguaaacuccacaagagcggcuaugugaccguggcucauacagggcagcacgaucuggucauuccucccaacggcuacuuucgguucgacucuugggugaaucaguucuauacccuugccccuaugggaaacggcacggggagacgccgggcucuguga

SEQ ID NO: 27687 - RNA, 1623 nt, Artificial Sequence
  derived and/or modified sequence opt5 from VP1__Norovirus__BAS30017
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucuacauucgucgugcagccucagaauggacgguguaccacggacggcguucuccuggggacaacccaacugucccccgugaacaucugcacauuucgcggagaugucacccauaucgccggcagcagaaauuacaccaugaaccucgcuucucugaauuggaacaauuaugacccuacagaagagauucccgcgccucuuggcacgcccgauuucguggggaaaauccagggaguccugacccagacaaccaagggcgacggguccacacggggacacaaggccaccguguacacgggcagcgcuccguuuacaccuaaacucggguccguucaguucggaaccgacaccgaaaacgauuuugagacacaucaaaauaccaaguucacacccgugggcgucauucaggacggcgggacgacccaccgcaacgaaccccagcaaugggugcugccuucuuacagcggaagaaauguuccgaacgugcaccuugcccccgccgucgcuccuacauuucccggcgagcagcuccuguucuuucgguccaccaugccuggguguagcggauaucccaauauggaucuggacugccugcucccucaggagugggugcagcauuucuaccaagaagccgcgcccgcucagucugauguggcccugcuucgcuuuguuaacccggacacaggcagaguccuguucgaguguaaacuccacaaguccggguaugugaccguggcccauacgggccagcacgaucuggucaucccucccaacggauacuuucgguucgacagcugggugaaucaguucuauacccuugcuccuaugggcaacgggacaggaagacgccgggcccuguga

SEQ ID NO: 27688 - RNA, 1623 nt, Artificial Sequence
  derived and/or modified sequence opt5 from VP1__Norovirus__BAS30023
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuggcagcagaaauuacacaaugaaccucgcgucucugaauuggaacaauuaugacccuaccgaagagauccccgccccucuuggcacccccgauuucguggggaaaauucagggaguccugacacagacgaccaagggcgacggguccacacggggacacaaggcuaccguguacacaggcagcgccccguuuaccccuaaacucggguccguucaguucucuacggacacagaaaacgauuuugagacccaucaaaauaccaaguucacacccgugggagucauccaggacggcggcaccacacaccgcaacgaaccccagcaaugggugcugccuagcuacuccgggagaaauguuccgaacgugcaccuugcccccgcugucgccccuacguuucccggagagcagcuccuguucuuucggagcaccaugccuggcuguucuggguaucccaauauggaucuggacugccugcucccucaggagugggugcagcauuucuaccaagaagcggcucccgcccaguccgauguggcccugcuucgcuuuguuaacccggacacaggaagaguccuguucgaguguaaacuccacaagagcggcuaugugaccguggcucauacagggcagcacgaucuggucauuccucccaacggcuacuuucgguucgacucuugggugaaucaguucuauacccuugccccuaugggaaacggcacggggagacgccgggcucuguga

SEQ ID NO: 27689 - RNA, 1623 nt, Artificial Sequence; identical to SEQ ID NO: 27567
  derived and/or modified sequence opt5 from VP1__Norovirus__BAS30026

SEQ ID NO: 27690 - RNA, 1623 nt, Artificial Sequence
  derived and/or modified sequence opt5 from VP1__Norovirus__BAS30029
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguucacaaugugcaucuugccccggcugucgcccccaccuuuccuggagagcagcuccuguucuuucggucuacaaugcccggcuguuccggguauccuaacauggaucuggacugccugcucccccaggagugggugcagcacuucuaccaagaagcggcuccugcccagagcgauguggcccugcuucgcuuuguuaaucccgacaccggaagaguccuguucgaguguaaacuccauaagucuggcuaugugacaguggcucacaccgggcagcacgaucuggucaucccgccuaacggcuacuuucgguucgacagcugggugaaccaguucuauacgcuugcccccaugggaaauggcaccgggagacgccgggcucuguga

SEQ ID NO: 27691 - RNA, 1623 nt, Artificial Sequence
  derived and/or modified sequence opt5 from VP1__Norovirus__BAS30035
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucggaacagacaccgaaaacgauuuugagacccaucaaaauacaaaguucacccccgugggcgucauucaggacggcgggacaacgcaccgcaacgaaccccagcaaugggugcugccuucuuacagcggaagaaauguuccgaacgugcaccuugcccccgcugucgccccuaccuuucccggcgagcagcuccuguucuuucgguccacaaugccuggguguagcggauaucccaauauggaucuggacugccugcucccucaggagugggugcagcauuucuaccaagaagcggcucccgcccagucugauguggcccugcuucgcuuuguuaacccggacaccggcagaguccuguucgaguguaaacuccacaaguccggguaugugacaguggcucauaccggccagcacgaucuggucaucccucccaacggauacuuucgguucgacagcugggugaaucaguucuauacgcuugccccuaugggcaacgggaccggaagacgccgggcucuguga

SEQ ID NO: 27692 - RNA, 1623 nt, Artificial Sequence; identical to SEQ ID NO: 27691
  derived and/or modified sequence opt5 from VP1__Norovirus__BAS30038

SEQ ID NO: 27693 - RNA, 1623 nt, Artificial Sequence; identical to SEQ ID NO: 27688
  derived and/or modified sequence opt5 from VP1__Norovirus__BAS30041

SEQ ID NO: 27694 - RNA, 1623 nt, Artificial Sequence
  derived and/or modified sequence opt5 from VP1__Norovirus__BAS30044
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgaaccucuuggcccggaucugaaucccuaccucucucaccuggcccgcauguauaacggguacgcuggaggcuucgagguccaggugauccuugccggcaaugcuuuuacagccgggaaaauuaucuucgcggccguuccucccaacuuuccuacggagggacugagccccucccaggugaccauguucccgcauaucauugucgacgugagacaacucgaaccugugcugaucccccugccugauguccggaauaacuuuuaucacuacaaucagucuaacgacagcacaauuaagcucaucgcuaugcuguauacaccccuucgcgccaacaaugcuggcgaggauguuuucaccguguccugcagagugcugacccggcccagcccugacuuugauuucauuuuucucgucccgcccacaguggaaucucgcaccaaaccuuucacgguucccauccugaccguggaggagaugacaaacuccagauuuccuauuccccuugaaaagcuguucaccgggccgagcucugccuucgucgugcagccucagaauggacgguguacaaccgacggcguucuccuggggacgacacaacugucccccgugaacaucugcaccuuucgcggagaugucacacauaucgccggcagcagaaauuacaccaugaaccucgcuucucugaauuggaacaauuaugacccuaccgaggaaauucccgcgccucuuggcacacccgauuucguggggaaaauccagggaguccugacgcagaccacaaagggcgacggguccacccggggacacaaggccacaguguacaccggcagcgcuccguuuacgccuaaacucggguccguucaguucucuacagacaccgagaacgauuuugaaacccaucaaaauacaaaguucacccccgugggagucauucaggacggcggcacaacgcaccgcaacgagccccagcaaugggugcugccuagcuacuccgggagaaauguuccgaacgugcaccuugcccccgccgucgcuccuaccuuucccggagagcagcuccuguucuuucggagcacaaugccuggcuguucuggguaucccaauauggaucuggacugccugcucccucaggaaugggugcagcauuucuaccaagaggccgcgcccgcucaguccgauguggcccugcuucgcuuuguuaacccggacaccggaagaguccuguucgaauguaaacuccacaagagcggcuaugugacaguggcccauaccgggcagcacgaucuggucaucccucccaacggcuacuuucgguucgacucuugggugaaucaguucuauacgcuugcuccuaugggaaacggcaccgggagacgccgggcccuguga

SEQ ID NO: 27695 - RNA, 1623 nt, Artificial Sequence; identical to SEQ ID NO: 27686
  derived and/or modified sequence opt5 from VP1__Norovirus__BAS30047

SEQ ID NO: 27696 - RNA, 1623 nt, Artificial Sequence; identical to SEQ ID NO: 27081
  derived and/or modified sequence opt5 from VP1__Norovirus__BAS30050

SEQ ID NO: 27697 - RNA, 1623 nt, Artificial Sequence
  derived and/or modified sequence opt5 from VP1__Norovirus__BAS30053
augaagauggccagcaacgacgcuacccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugacagcaccauuaagcucaucgccaugcuguauacaccccuucgcgcuaacaacgccggcgaagauguuuucaccguguccugcagagugcugacacggcccagcccugacuuugauuucauuuuucucgucccgcccaccguggagucucgcacgaaaccuuucaccguucccauccugacaguggaagagaugaccaauuccagauuuccuauuccccuugagaagcuguucacagggccgagcucugccuucgucgugcagccucagaacggacgguguaccacggacggcguucuccuggggacaacccaacugucccccgugaauaucugcacauuucgcggagaugucacccauaucgcuggcagcagaaacuacaccaugaaucucgcgucucugaacuggaauaacuaugacccuacagaagagauucccgccccucuuggcacgcccgauuucguggggaaaauccagggaguccugacccagacaaccaagggcgacggguccacacggggacacaaggcuaccguguacacgggcagcgccccguuuacaccuaaacucggguccguucaguucaauaccgacaccgaaaacgauuuugagacacaucaaaauaccaaguucacacccgugggagucauucaggacggcucuacgacccaccgcaacgaaccccagcaaugggugcugccuagcuacuccggcagaaauguuccgaacgugcaccuugcccccgcugucgccccuacauuucccggggagcagcuccuguucuuucggagcaccaugccuggauguucuggcuaucccaauauggaucuggacugccugcucccucaggagugggugcagcauuucuaccaagaagcggcucccgcccaguccgauguggcccugcuucgcuuuguuaacccggacacagggagaguccuguucgaguguaaacuccacaagagcggauaugugaccguggcucauacgggccagcacgaucuggucaucccucccaacggguacuuucgguucgacucuugggugaaucaguucuauacccuugccccuaugggcaacggaacaggcagacgccgggcucuguga

SEQ ID NO: 27698 - RNA, 1623 nt, Artificial Sequence; identical to SEQ ID NO: 27688
  derived and/or modified sequence opt5 from VP1__Norovirus__BAS30056

SEQ ID NO: 27699 - RNA, 1623 nt, Artificial Sequence
  derived and/or modified sequence opt5 from VP1__Norovirus__BAS30059
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaagacacaaaguucacccccgugggagucauucaggauggcggcacaacgcaccgcaaugaaccccagcaaugggugcugccuagcuacuccgggagaaacguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaauccggauaccggaagaguccuguucgaguguaaacuccacaagagcggcuaugugacaguggcucauaccgggcagcacgaccuggucaucccucccaacggcuacuuucgguucgauucuugggugaaccaguucuauacgcuugccccuaugggaaauggcaccgggagacgccgggcucuguga

SEQ ID NO: 27700 - RNA, 1623 nt, Artificial Sequence; identical to SEQ ID NO: 27607
  derived and/or modified sequence opt5 from VP1__Norovirus__BAS30062

SEQ ID NO: 27701 - RNA, 1623 nt, Artificial Sequence
  derived and/or modified sequence opt5 from VP1__Norovirus__BAS30065
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacaguugugaaaacgacccugagcgcggucccucccaacuucccuacagaggggcucucccccucucaggugaccauguuuccgcauauuaucguggacgucagacaacuggagccuguucugaucccccucccugaugugcggaauaacuucuaucacuacaaucagagcaacgacuccacaauuaagcugaucgccaugcuuuauacaccccugcgcgcuaacaaugccggagaagauguguuuaccgucagcugcagagugcucacccggcccucuccugacuucgauuuuauuuuccugguuccgcccacgguggagucccgcaccaaaccuuuuacaguccccauccuuaccguggaagagaugacaaacagcagauucccuauuccccuggagaagcucuuuaccggcccgucuuccgcuuucguugugcagccucagaaugggcgguguacgacagacggaguccugcugggcaccacacaacucagccccgugaacaucugcaccuuccgcggggaugucacccauauugccggaucuagaaauuacacaaugaaccuggccucccuuaauuggaacaauuaugacccuacggaagagauccccgcuccucugggcacccccgauuuugugggcaaaauccaggggguucucacacagaccacaaagggagacggcagcacccgggggcacaaggcgacgguguacacaggauccgccccguucaccccuaaacugggcucuguccaguuuagcaccgacacagaaaacgauuucgagacccaucaaaauacaaaguuuacgcccguggggguuauucaggacggaggcaccacacaccgcaacgaaccccagcaaugggugcuuccuuccuacagcggcagaaaugucccgaacgugcaccuggcucccgccguggccccuaccuuccccggggagcagcuccuguuuuuccggucuacaaugccuggauguuccggcuaucccaauauggaucuggacugccuccugccucaggaguggguucagcauuuuuaccaagaagcugcccccgcgcagagcgaugucgcccuucugcgcuucgugaacccggacaccgggagagugcucuuugaguguaaacugcacaagucuggauaugucacgguggcucauaccggccagcacgaucuuguuaucccucccaacggguacuuccgguuugacagcugggugaaucaguucuauacacuggccccuaugggcaacggaaccggcagacgccgggcucucuga

SEQ ID NO: 27702 - RNA, 1623 nt, Artificial Sequence
  derived and/or modified sequence opt5 from VP1__Norovirus__BAS30068
augaagauggccagcaacgacgcuaccgccuccgauggcucugcggcuaaucuggugcccgaggucaacaaugaaguuauggcccucgagccuguggugggggccgcuaucgccgcuccggucgccggacagcaaaacgugauugaccccuggaucagaaauaacuucguucaggcgccuggcggggaauuuacagugagcccccggaaugccccuggagagauucugugguccgcuccccuuggcccugaucugaacccguaccucucucaccuggcccgcauguauaauggguacgcuggaggcuucgaaguccaggugauccuugccggcaacgcguuuacggccgggaaaauuaucuucgcugccguucccccuaauuuucccaucgagggacugagcccuucccaggugaccauguucccccauauuaucgucgacgugagacaacucgagccggugcugauuccucugcccgauguccggaacaauuuuuaucacuacaaccagucuaaugacagcacaaucaagcucauugcuaugcuguauaccccucuucgcgccaacaacgccggcgaagauguuuucacaguguccugcagagugcugacccggcccagccccgacuuugauuucaucuuucucgucccuccgacaguggagucucgcaccaaacccuucacgguuccuauucugaccguggaagagaugacaaauuccagauuucccaucccucuugagaagcuguucaccgggcccagcucugcuuucgucgugcagccgcagaacggacgguguacaaccgacggcguucuccuggggacgacacaacuguccccugugaauaucugcaccuuucgcggagaugucacacauauugcgggcagcagaaacuacaccaugaaucucgccucucugaacuggaauaacuaugaccccaccgaagagaucccugcuccccuuggcacaccugauuucguggggaaaauucagggaguccugacgcagaccacaaagggcgacggguccacccggggacacaaggccacaguguacaccggcagcgcccccuuuacgccgaaacucggguccguucaguucucuacagacaccgaaaaugauuuugagacccaucaaaacacaaaguucaccccugugggagucauccaggacggcggcacaacgcaccgcaaugaaccccagcaaugggugcugcccagcuacuccgggagaaacguuccuaaugugcaccuugcuccggccgucgcgcccaccuuuccuggagagcagcuccuguucuuucggagcacaaugcccggcuguucuggguauccuaacauggaucuggacugccugcucccccaggagugggugcagcauuucuaccaagaagcugccccugcccaguccgauguggcucugcuucgcuuuguuaaucccgacaccggaagaguccuguucgaguguaaacuccacaagagcggcuaugugacaguggcccauaccgggcagcacgaucuggucauuccgccuaacggcuacuuucgguucgacucuugggugaaccaguucuauacgcuugcucccaugggaaauggcaccgggagacgccgggcccuguga

SEQ ID NO: 27703 - RNA, 1623 nt, Artificial Sequence; identical to SEQ ID NO: 27688
  derived and/or modified sequence opt5 from VP1__Norovirus__BAS30071

SEQ ID NO: 27704 - RNA, 1623 nt, Artificial Sequence; identical to SEQ ID NO: 27688
  derived and/or modified sequence opt5 from VP1__Norovirus__BAS30074

SEQ ID NO: 27705 - RNA, 1623 nt, Artificial Sequence
  derived and/or modified sequence opt5 from VP1__Norovirus__BAS30077
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagccacaauuacaccaugaaccucgcgucucugaauuggaacaauuaugacccuaccgaagagauucccgccccucuuggcacacccgauuucguggggaaaauccagggaguccugacgcagaccacaaagggcgacggguccaccagaggacauaaggcuacaguguacaccggcagcgccccguuuacgccuaaacucggguccguucaguucucuacagacaccgaaaacgauuuugagacccaccaaaauacaaaguucacccccgugggagucauucaggacggcggcacagcccaccggaacgaaccccagcaaugggugcugccuagcuacuccgggcgcaauguucagaacgugcaucuugcuccggccgucgcgcccacguuuccuggagagcagcuccuguucuuuagaagcaccaugcccggcuguucuggguauccuaauauggaucuggacugccugcucccccaggagugggugcaacacuucuaccaggaagcugccccugcccaguccgauguggcucugcuucgguuuguuaaccccgacacaggacgcguccuguucgaguguaaacuccauaagagcggcuaugugaccguggcccacacagggcagcacgaucuggucaucccgccuaacggcuacuuuagauucgacucuugggugaaucaauucuauacccuugcucccaugggaaacggcacggggcggagacgcgcccuguga

SEQ ID NO: 27706 - RNA, 1623 nt, Artificial Sequence
  derived and/or modified sequence opt5 from VP1__Norovirus__BAS30080
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggcagauuaucuucgccgcuguuccucccaacuuuccuacggagggacugagccccucccaagugaccauguucccgcauaucauugucgacgugagacagcucgagccugugcugaucccccugccugauguccggaauaacuuuuaucacuacaaucagucuaacgacagcacaauuaaacucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaagccuuucacgguucccauccugaccguggaagagaugacaaacuccagauuuccuauuccccuugagaaacuguucaccgggccgagcucugccuucgucgugcagccucaaaauggacgguguacaaccgacggcguucuccuggggacgacacagcugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaagauccagggaguccugacgcagaccacaaaaggcgacggguccacccggggacacaaggcuacaguguacaccggcagcgccccguuuacgccuaagcucggguccguucaauucucuacagacaccgaaaacgauuuugagacccaucagaauacaaaauucacccccgugggagucauucaggacggcggcacaacgcaccgcaacgaaccccaacagugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcaacauuucuaccaggaagcggcucccgcccaguccgauguggcccugcuucgcuuuguuaacccggacaccggaagaguccuguucgaguguaagcuccacaaaagcggcuaugugacaguggcucauaccgggcagcacgaucuggucaucccucccaacggcuacuuucgguucgacucuugggugaaucaauucuauacgcuugccccuaugggaaacggcaccgggagacgccgggcucuguga

SEQ ID NO: 27707 - RNA, 1623 nt, Artificial Sequence; identical to SEQ ID NO: 27081
  derived and/or modified sequence opt5 from VP1__Norovirus__BAS30083

SEQ ID NO: 27708 - RNA, 1623 nt, Artificial Sequence
  derived and/or modified sequence opt5 from VP1__Norovirus__BAS30086
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccgugcugaccgucgaagagaugacaaacuccagauuuccuaucccccuugagaagcuguucaccgggccgagcucugccuucgugguucagccucagaauggacgguguacaaccgacggcgugcuccuggggacgacacaacugucccccgucaacauuugcaccuuucgcggagaugugacacauaucgcuaauagccacaacuacaccaugaaucucgcgucucugaacuggaauaacuaugacccuaccgaagagauccccgccccucuuggcacacccgauuucgucggcaaaauucagggggugcugacgcagaccacaaagggagacggcuccaccagagggcauaaggcuacaguuuacaccggaagcgccccguuuacgccuaaacucggcuccgugcaguucucuacagacaccgaaaaugauuuugagacccaccaaaacacaaaguucacccccgucggggugauccaggacggaggcacaacgcaccggaaugaaccccagcaauggguucugccuagcuacuccggccgcaacgugcagaauguccaucuugccccggcuguggcccccaccuuuccuggggagcagcuccuguucuuuagaagcacaaugcccggauguucuggcuauccuaacauggaucuggacugccugcucccccaggagugggugcaacacuucuaccaggaagcggcuccugcccaguccgauguugcccugcuucgguuugucaaccccgacaccgggcgcgugcuguucgaguguaaacuccauaagagcggauaugugacagucgcucacaccggccagcacgaucuggugauuccgccuaauggguacuuuagauucgacucuuggguuaaccaauucuauacgcuugcccccaugggcaauggaaccggccggagacgcgcucuguga

SEQ ID NO: 27709 - RNA, 1623 nt, Artificial Sequence
  derived and/or modified sequence opt5 from VP1__Norovirus__BAS30089
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugagcaucugcaccuuucgcggagacgucacacauaucgcuggcucuagagauuacaccaugaaccucgcgucccugaauuggaacaauuaugacccuaccgaggaaauucccgccccucuuggcacacccgacuucguggggaaaauccagggaguccugacgcagaccacaaagggcgaugggagcacccggggacacaaggcuacaguguacaccggcuccgccccguuuacgccuaaacucgggucuguucaguucagcacagacaccgagaacgauuuugaaacccaucaaaauacaaaguucacccccgugggagucauucaggacggcuccacagcccaccgcaacgagccccagcaaugggugcugccuagcuacucuggcagaaauguucagaacgugcaccuugcuccggccgucgcgcccacguuuccuggggaacagcuccuguucuuucgguccaccaugcccggauguagcggcuauccuaauauggaucuggacugccugcucccccaggagugggugcaacauuucuaccaggaggcugccccugcccagucugauguggcucugcuucgcuuuguuaaccccgacacagggagaguccuguucgaauguaaacuccacaagagcggauaugugaccguggcccauacaggccagcacgaucuggucaucccgccuaauggguacuuucgguucgacuccugggugaaccaauucuauacccuugcucccaugggcaacggaacgggcagacgccgggcccuguga

SEQ ID NO: 27710 - RNA, 1623 nt, Artificial Sequence
  derived and/or modified sequence opt5 from VP1__Norovirus__BAS30092
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuagcucuagaaauuacacaaugaaccucgcgucccugaauuggaacaauuaugacccuaccgaagagauccccgccccucuuggcacccccgauuucgugggcaaaauucaggggguccugacacagacgaccaagggagacggcagcacacgggggcacaaggcuaccguguacacaggauccgccccguuuaccccuaaacucggcucuguucaguucagcacggacacagaaaacgauuuugagacccaucaaaauaccaaguucacacccgugggggucauccaggacggaggcaccacacaccgcaacgaaccccagcaaugggugcugccuuccuacagcggcagaaauguuccgaacgugcaccuugcccccgcugucgccccuacguuucccggggagcagcuccuguucuuucggucuaccaugccuggauguuccggcuaucccaauauggaucuggacugccugcucccucaggagugggugcagcauuucuaccaagaagcggcucccgcccagagcgauguggcccugcuucgcuuuguuaacccggacacagggagaguccuguucgaguguaaacuccacaagucuggauaugugaccguggcucauacaggccagcacgaucuggucauuccucccaacggguacuuucgguucgacagcugggugaaucaguucuauacccuugccccuaugggcaacggaacgggcagacgccgggcucuguga

SEQ ID NO: 27711 - RNA, 1623 nt, Artificial Sequence
  derived and/or modified sequence opt5 from VP1__Norovirus__BAS30095
augaagauggccagcaacgacgcuaaucccuucgauggcuccgccgcgaaccuggugccugaggucaauaacgaaguuauggcucucgagccgguggugggggccgccaucgcugcccccgucgcuggacagcaaaaugugauugacccuuggaucagaaacaauuuuguucaggcccccggcggggaguucaccgugucuccucggaacgcgcccggagaaauucuguggagcgccccucuuggcccggaucugaaucccuaccucucccaccuggcucgcauguauaacggguacgccggaggcuuugaaguccaggugauccuugcuggcaaugccuucacagcggggaaaauuaucuuugccgcuguuccucccaacuucccugccgagggacugucucccagccaggugacgauguuuccgcauaucauugucgacgugagacaacucgagccugugcugaucccccugccugauguccggaauaacuucuaucacuacaaucaguccaacgacucuaccauuaagcucaucgcuaugcuguauacaccccuucgcgccaacaaugccggcgaagauguuuuuaccgugagcugcagagugcugacacggcccuccccugacuucgauuuuauuuuccucgucccgcccaccguggagagccgcacaaaaccuuuuaccguucccauccugacgguggaagagaugaccaacucuagauucccuauuccccuugagaagcuguucacagggccguccagcgcuuuugucgugcagccucagaauggacgguguaccacagacggcguucuccuggggaccacgcaacugucucccgugaacaucugcacauuccgcggagaugucacccauaucgcgggcuccagaaauuacacaaugaaccucgccagccugaauuggaacaauuaugacccuaccgaagagauucccgcuccucuuggcacccccgauuuuguggggaaaauccagggaguccugacacagacgaccaagggcgacgggucuacacggggacacaaggccaccguguacacaggcuccgccccguucaccccuaaacucgggagcguucaguuuuccacggacacagaaaacgauuucgagacccaucaaaauaccaaguuuacacccgugggagucauucaggacggcggcaccacacaccgcaacgaaccccagcaaugggugcugccuucuuacagcgggagaaauguuccgaacgugcaccuugcucccgccgucgcgccuacguuccccggagagcagcugcucuuuuuccgguccaccaugccuggcuguagcggguaucccaauauggaucuggacugccugcucccucaggagugggugcagcauuuuuaccaagaagcugcccccgcccagucugauguggcucugcuucgcuucguuaacccggacacaggaagaguccuguuugaguguaaacuccacaaguccggcuaugugaccguggcccauacagggcagcacgaucuggucaucccucccaacggcuacuuccgguucgacagcugggugaaucaguuuuauacccuugcuccuaugggaaacggcacggggagacgccgggcccuguga

SEQ ID NO: 27712 - RNA, 1623 nt, Artificial Sequence
  derived and/or modified sequence opt5 from VP1__Norovirus__BAS30098
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucaucguccagccucagaauggacgguguacaaccgacggcgugcuccuggggacgacacaacugucccccguuaacaucugcaccuuucgcggagaugugacacauauugcuggcagcagaaauuacaccaugaaccucgcgucucugaauuggaacaauuaugacccuaccgaagagauccccgccccucuuggcacacccgauuucgucgggaaaauucagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauccaggacggcggcacaacgcaccgcaacgaaccccagcaauggguccugccuagcuacuccgggagaaaugugccgaacguucaccuugcccccgcuguggccccuaccuuucccggagagcagcuccuguucuuucggagcacaaugccuggcuguucuggguaucccaauauggaucuggacugccugcucccucaggaguggguccagcauuucuaccaagaagcggcucccgcccaguccgauguggcccugcuucgcuuugugaacccggacaccggaagaguucuguucgaguguaaacuccacaagagcggcuaugucacaguggcucauaccgggcagcacgaucuggugauuccucccaacggcuacuuucgguucgacucuugggucaaucaguucuauacgcuugccccuaugggaaacggcaccgggagacgccgggcucuguga

SEQ ID NO: 27713 - RNA, 1623 nt, Artificial Sequence
  derived and/or modified sequence opt5 from VP1__Norovirus__BAS30101
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacagcccaccgcaacgaaccccagcaaugggugcugccuuccuacagcggcagaaauguucagaacgugcaccuugcuccggccgucgcgcccacguuuccuggggagcagcuccuguucuuucggucuaccaugcccggauguuccggcuauccuaauauggaucuggacugccugcucccccaggagugggugcaacauuucuaccaggaagcugccccugcccagagcgauguggcucugcuucgcuuuguuaaccccgacacagggagaguccuguucgaguguaaacuccacaagucuggauaugugaccguggcccauacaggccagcacgaucuggucaucccgccuaacggguacuuucgguucgacagcugggugaaucaauucuauacccuugcucccaugggcaacggaacgggcagacgccgggcccuguga

SEQ ID NO: 27714 - RNA, 1623 nt, Artificial Sequence
  derived and/or modified sequence opt5 from VP1__Norovirus__BAS30104
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgaaaaugacuuugagacccaucaaaacgccaaguucacacccgugggagucauucaggauggcagcaccacacaccgcaaugaaccccagcaaugggugcugccuuccuacagcggcagaaacguuccgaaugugcaccuugcucccgccgucgcgccuacguuucccggggagcagcuccuguucuuucggucuaccaugccuggauguuccggcuaucccaacauggaccuggauugccugcucccucaggagugggugcagcauuucuaccaagaagcugcccccgcccagagcgacguggcucugcuucgcuuuguuaauccggauacagggagaguccuguucgaguguaaacuccacaagucuggauaugugaccguggcccauacaggccagcacgaccuggucaucccucccaacggguacuuucgguucgauagcugggugaaccaguucuauacccuugcuccuaugggcaauggaacgggcagacgccgggcccuguga

SEQ ID NO: 27715 - RNA, 1623 nt, Artificial Sequence
  derived and/or modified sequence opt5 from VP1__Norovirus__BAS30107
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcucugccuucgucgugcagccucagaauggacgguguaccacggacggcguucuccuggggacaacccaacugucccccgugaacaucugcacauuucgcggagaugucacccauaucgccggcagccacaauuacaccaugaaccucgcuucucugaauuggaacaauuaugacccuacagaagagauucccgcgccucuuggcacgcccgauuucguggggaaaauccagggaguccugacccagacaaccaagggcgacggguccacaagaggacauaaggccaccguguacacgggcagcgcuccguuuacaccuaaacucggguccguucaguucucuaccgacaccgaaaacgauuuugagacacaccaaaauaccaaguucacacccgugggagucauucaggacggcggcacgacccaccggaacgaaccccagcaaugggugcugccuagcuacuccgggcgcaauguucagaacgugcaucuugccccggccgucgcucccacauuuccuggagagcagcuccuguucuuuagaagcaccaugcccggcuguucuggguauccuaauauggaucuggacugccugcucccccaggagugggugcaacacuucuaccaggaagccgcgccugcucaguccgauguggcccugcuucgguuuguuaaccccgacacaggacgcguccuguucgaguguaaacuccauaagagcggcuaugugaccguggcccacacggggcagcacgaucuggucaucccgccuaacggcuacuuuagauucgacucuugggugaaucaauucuauacccuugcucccaugggaaacggcacagggcggagacgcgcccuguga

SEQ ID NO: 27716 - RNA, 1623 nt, Artificial Sequence; identical to SEQ ID NO: 27688
  derived and/or modified sequence opt5 from VP1__Norovirus__BAS30110

SEQ ID NO: 27717 - RNA, 1623 nt, Artificial Sequence; identical to SEQ ID NO: 27081
  derived and/or modified sequence opt5 from VP1__Norovirus__BAS30113

SEQ ID NO: 27718 - RNA, 1623 nt, Artificial Sequence
  derived and/or modified sequence opt5 from VP1__Norovirus__BAS30116
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaaugcugacgcagaccacaaagggcgacggguccacccggggacacaaggcuacagucuacaccggcagcgccccguuuacgccuaaacucggguccgugcgcuucucuacagauaccgaaaaugacuuugagauucaucagaacaccaaguucacacccguuggagugauccaagauggcagcaccacacacagaaaugaaccccagcaguggguccugccuuccuacagcggccgggacgcccacaacgugcaucuugcuccggccguugcgcccacguuuccuggggagcaacuccuguucuuucgcucuaccaugcccggauguuccggcuauccuaauauggaucuggacugccugcucccccaggagugggugcagcacuucuaccaggaagcugccccugcccaaagcgaugucgcucugcuuagauuugugaaccccgacacagggcgggugcuguucgaguguaaacuccauaagucuggauauguuaccgucgcccacacaggccagcacgaucuggugauuccgccuaauggguacuuuagauucgacagcugggugaaccaguucuauacccuugcucccaugggcaacggaacgggccgccggagagcccuguga

SEQ ID NO: 27719 - RNA, 1623 nt, Artificial Sequence; identical to SEQ ID NO: 27688
  derived and/or modified sequence opt5 from VP1__Norovirus__BAS30119

SEQ ID NO: 27720 - RNA, 1623 nt, Artificial Sequence
  derived and/or modified sequence opt5 from VP1__Norovirus__BAS30125
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagagacuacaccaugaaucucgcgucucugaacuggaauaacuaugauccuaccgaagagauucccgccccucuuggcacacccgacuucguggggaaaauccagggaaugcugacgcagaccacaaagggcgacggguccacccggggacacaaggcuacagucuacaccggcagcgccccguuuacgccuaaacucggguccgugcgcuucucuacagauaccgaaaaugacuuugagauucaucagaacaccaaguucacacccguuggagugauccaagauggcagcaccacacacagaaaugaaccccagcaguggguccugccuuccuacagcggccgggacgcccacaacgugcaucuugcuccggccguugcgcccacguuuccuggggagcaacuccuguucuuucgcucuaccaugcccggauguuccggcuauccuaauauggaucuggacugccugcucccccaggagugggugcagcacuucuaccaggaagcugccccugcccaaagcgaugucgcucugcuuagauuugugaaccccgacacagggcgggugcuguucgaguguaaacuccauaagucuggauauguuaccgucgcccacacaggccagcacgaucuggugauuccgccuaauggguacuuuagauucgacagcugggugaaccaguucuauacccuugcucccaugggcaacggaacgggccgccggagaguccuguga

SEQ ID NO: 27721 - RNA, 1623 nt, Artificial Sequence; identical to SEQ ID NO: 27081
  derived and/or modified sequence opt5 from VP1__Norovirus__BAS30128

SEQ ID NO: 27722 - RNA, 1623 nt, Artificial Sequence
  derived and/or modified sequence opt5 from VP1__Norovirus__BAS30134
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagagaugugccgaauguucaccuugcccccgcuguggccccuaccuuucccggggagcagcuccuguucuuucggucuacaaugccuggauguuccggcuaucccaacauggaccuggauugccugcucccucaggaguggguccagcauuucuaccaagaagcggcucccgcccagagcgacguggcccugcuucgcuuugugaauccggauaccgggagaguucuguucgaguguaaacuccacaagucuggauaugucacaguggcucauaccggccagcacgaccuggugaucccucccaacggguacuuucgguucgauagcugggucaaccaguucuauacgcuugccccuaugggcaauggaaccggcagacgccgggcucuguga

SEQ ID NO: 27723 - RNA, 1623 nt, Artificial Sequence; identical to SEQ ID NO: 27081
  derived and/or modified sequence opt5 from VP1__Norovirus__BAS30137

SEQ ID NO: 27724 - RNA, 1623 nt, Artificial Sequence; identical to SEQ ID NO: 27081
  derived and/or modified sequence opt5 from VP1__Norovirus__BAS30140

SEQ ID NO: 27725 - RNA, 1623 nt, Artificial Sequence
  derived and/or modified sequence opt5 from VP1__Norovirus__BAS30146
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuggcagccacaauuacacaaugucucucgcgucccugaacuggaauaacuaugacccuaccgaagagauccccgccccucuuggcacccccgauuucguggggaaaauucagggaguccugacacagacgaccaagggcgacgggagcacaagaggacauaaggcuaccguguacacaggcuccgccccguuuaccccuaaacucgggucuguucaguucagcacggacacagaaaaugauuuugagacccaccaaaacaccaaguucacacccgugggagucauccaggacggcggcaccacacaccggaaugaaccccagcaaugggugcugccuuccuacagcgggcgcaacguuccgaaugugcaucuugcccccgcugucgccccuacguuucccggagagcagcuccuguucuuuagaucuaccaugccuggcuguuccggguaucccaacauggaucuggacugccugcucccucaggagugggugcagcacuucuaccaagaagcggcucccgcccagagcgauguggcccugcuucgguuuguuaauccggacacaggacgcguccuguucgaguguaaacuccauaagucuggcuaugugaccguggcucacacagggcagcacgaucuggucauuccucccaacggcuacuuuagauucgacagcugggugaaccaguucuauacccuugccccuaugggaaauggcacggggcggagacgcgcucuguga

SEQ ID NO: 27726 - RNA, 1623 nt, Artificial Sequence
  derived and/or modified sequence opt5 from VP1__Norovirus__BAS30149
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguuccgaacgugcaccuugcccccgcugucgccccuaccuuucccggggagcagcuccuguucuuucggucuacaaugccuggauguuccggcuaucccaauauggaucuggacugccugcucccucaggagugggugcagcauuucuaccaagaagcggcucccgcccagagcgauguggcccugcuucgcuuuguuaacccggacaccgggagaguccuguucgaguguaaacuccacaagucuggauaugugacaguggcucauaccggccagcacgaucuggucaucccucccaacggguacuuucgguucgacagcugggugaaucaguucuauacgcuugccccuaugggcaacggaaccggcagacgccgggcucuguga

SEQ ID NO: 27727 - RNA, 1623 nt, Artificial Sequence; identical to SEQ ID NO: 27081
  derived and/or modified sequence opt5 from VP1__Norovirus__BAS30152

SEQ ID NO: 27728 - RNA, 1623 nt, Artificial Sequence
  derived and/or modified sequence opt5 from VP1__Norovirus__BAS30155
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuuaaaggcgaugucacacauaucgcuggcucccgcaauuacaccaugaaccucgcgagccugaauuggaacaauuaugacccuaccgaagagauucccgccccucuugggacacccgauuucgugggaaagauccagggcguccugacgcagaccacaaagggggacggaucuaccagaggccacaaagcuacaguguacaccggguccgccccguuuacgccuaagcucggaagcguucaguucuccacagacaccgaaaacgauuuugagacccaucaaaauacaaaauucacccccgugggcgucauucaggacggcgggacaacgcaccagaacgaaccccaacagugggugcugccuucuuacagcggacgggauguuccgaaugugcaccuugcccccgcugucgccccuaccuuucccggcgagcagcuccuguucuuucgcuccacaaugccuggguguagcggauaucccaacaugaaucuggacugccugcucccucaggagugggugcaacauuucuaccaggaagcggcucccgcccagucugauguggcccugcuuagauuuguuaacccggacaccggccggguccuguucgaguguaagcuccacaaauccggguaugugacaguggcucauaccggccagcacgaucuggucaucccucccaacggauacuuucgcuucgacagcugggugaaucaauucuauacgcuugccccuaugggcaacgggaccggaagacggagagcucuguga

SEQ ID NO: 27729 - RNA, 1623 nt, Artificial Sequence
  derived and/or modified sequence opt5 from VP1__Norovirus__BAS30158
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagcucaacgacucuaccaucaagcugauugccaugcuuuauacaccccugcgcgcuaacaaugccggcgaagauguuuucaccgugagcugcagagugcucacacggcccuccccugacuuugauuucaucuuucuggucccgcccaccguggagagccgcacaaaaccuuucaccguucccauucuuacgguggaagagaugaccaacucuagauuuccuaucccccuggagaaacucuucacagggccguccagcgccuucgucgugcagccucagaauggacgguguaccacagacggcguucugcuggggaccacgcaacucucucccgugaacaucugcacauuucgcggagaugucacccauauugcuggcuccagaaauuacacaaugagccuggcgucucuuaacuggaauaacuaugacccuaccgaagagauccccgccccucugggcacccccgauuucguggggaagauucagggaguccucacacagacgaccaagggcgacggguccacacggggacacaaggcuaccguguacacaggcagcgccccguuuaccccuaaacugggguccguucaguucucuacggacacagaaaaugauuuugagacccaucaaaacaccaaguucacacccgugggagucauccaggacggcggcaccacacaccgcaaugaaccccagcaaugggugcuuccuagcuacuccgggagaaacguuccgaaugugcaccuggcccccgcugucgccccuacguuucccggagagcagcuccuguucuuucggagcaccaugccuggcuguucuggguaucccaacauggaucuggacugccuccugccucaggagugggugcagcauuucuaccaagaagcggcucccgcccaguccgauguggcccuucugcgcuuuguuaauccggacacaggaagaguccucuucgaguguaaacugcacaagagcggcuaugugaccguggcucauacagggcagcacgaucuugucauuccucccaacggcuacuuucgguucgacucuugggugaaccaguucuauacccuggccccuaugggaaauggcacggggagacgccgggcucucuga

SEQ ID NO: 27730 - RNA, 1623 nt, Artificial Sequence
  derived and/or modified sequence opt5 from VP1__Norovirus__BAS30164
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacaaaaccuuucaccguucccauucugacgguggaagagaugaccaacuccagauuuccuaucccccuugagaagcuguucacagggccgagcucugccuucgucgugcagccucagaauggacgguguaccacagacggcguucuccuggggaccacgcaacugucccccgugaacaucugcacauuucgcggagaugucacccauauugcuggcagcagaaauuacacaaugucucucgcgucccugaacuggaauaacuaugacccuaccgaagagauccccgccccucuuggcacccccgauuucguggggaaaauucagggaguccugacacagacgaccaagggcgacgggagcacacggggacacaaggcuaccguguacacaggcuccgccccguuuaccccuaaacucgggucuguucaguucagcacggacacagaaaaugauuuugagacccaucaaaacaccaaguucacacccgugggagucauccaggacggcggcaccacacaccgcaaugaaccccagcaaugggugcugccuuccuacagcgggagaaacguuccgaaugugcaccuugcccccgcugucgccccuacguuucccggagagcagcuccuguucuuucggucuaccaugccuggcuguuccggguaucccaacauggaucuggacugccugcucccucaggagugggugcagcauuucuaccaagaagcggcucccgcccagagcgauguggcccugcuucgcuuuguuaauccggacacaggaagaguccuguucgaguguaaacuccacaagucuggcuaugugaccguggcucauacagggcagcacgaucuggucauuccucccaacggcuacuuucgguucgacagcugggugaaccaguucuauacccuugccccuaugggaaauggcacggggagacgccgggcucuguga

SEQ ID NO: 27731 - RNA, 1623 nt, Artificial Sequence; identical to SEQ ID NO: 27726
  derived and/or modified sequence opt5 from VP1__Norovirus__BAS30167

SEQ ID NO: 27732 - RNA, 1623 nt, Artificial Sequence; identical to SEQ ID NO: 27081
  derived and/or modified sequence opt5 from VP1__Norovirus__BAS30170

SEQ ID NO: 27733 - RNA, 1623 nt, Artificial Sequence
  derived and/or modified sequence opt5 from VP1__Norovirus__BAS30173
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcaguacgaucuggucaucccucccaacggcuauuuucgguucgacucuugggugaaucaguucuacacgcuugccccuaugggaaacggcaccgggagacgccgggcucuguga

SEQ ID NO: 27734 - RNA, 1623 nt, Artificial Sequence
  derived and/or modified sequence opt5 from VP1__Norovirus__BAS30176
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagacacugugguccgccccucuuggcccggaucugaaucccuaccucucucaccuggcucgcauguauaacggguacgccggaggcuucgaaguccaggugauucuugcuggcaaugccuuuacggcggggaaaaucauuuucgccgcuguuccucccaacuuuccuaccgagggacugagccccucccaggugacaauguucccgcauaucaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaagauguuuucaccguguccugcagagugcugacacggcccagcccugacuuugauuucaucuuucucgucccgcccaccguggagucucgcacgaaaccuuucaccguucccauucugacaguggaagagaugaccaacuccagauuuccuaucccccuugagaagcuguucacagggccgagcucugccuucgucgugcagccucagaauggacgguguaccacggacggcguucuccuggggacaacccaacugucccccgugaacauuugcacauuucgcggagaugucacccauaucgcuggcagcagaaauuacaccaugaaccucgcgucucugaauuggaacaauuaugacccuacagaagagauccccgccccucuuggcacgcccgauuucguggggaaaauucagggaaugcugacccagacaaccaagggcgacggguccacacggggacacaaggcuaccgucuacacgggcagcgccccguuuacaccuaaacucggguccgugcaguucucuaccgacaccgaaaacgauuuugagacacaucaaaauaccaaguucacacccguuggagugauccaggacggcagcacgacccaccgcaacgaaccccagcaauggguccugccuuccuacagcggcagaaaugugccgaacguucaccuugcccccgcuguggccccuacauuucccggggagcagcuccuguucuuucggucuaccaugccuggauguuccggcuaucccaauauggaucuggacugccugcucccucaggaguggguccagcauuucuaccaagaagcggcucccgcccagagcgauguggcccugcuucgcuuugugaacccggacacagggagaguucuguucgaguguaaacuccacaagucuggauaugucaccguggcucauacgggccagcacgaucuggugauuccucccaacggguacuuucgguucgacagcugggucaaucaguucuauacccuugccccuaugggcaacggaacaggcagacgccgggcucuguga

SEQ ID NO: 27735 - RNA, 1623 nt, Artificial Sequence
  derived and/or modified sequence opt5 from VP1__Norovirus__BAS30179
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggccuccugcuggggacgacacaacucucccccguuaacaucugcaccuuucgcggagaugugacacauaucgcuggcagcagaaauuacaccaugaaccuggcgucucuuaauuggaacaauuaugacccuaccgaagagauucccgccccucugggcacacccgauuucgucgggaaaauccagggaaugcucacgcagaccacaaagggcgacggguccacccggggacacaaggcuacaguguacaccggcagcgccccguuuacgccuaaacugggguccguccaguucucuacagacaccgaaaacgauuuugagacccaucaaaauacaaaguucacccccgugggaguuauucaggacggcagcacaacgcaccgcaacgaaccccagcaaugggugcuuccuuccuacagcggcagaaaugucccgaacgugcaccuggcccccgcuguugccccuaccuuucccggggagcagcuccuguucuuucggucuacaaugccuggauguuccggcuaucccaauauggaucuggacugccuccugccucaggagugggugcagcauuucuaccaagaagcggcucccgcccagagcgaugucgcccuucugcgcuuugugaacccggacaccgggagaguucucuucgaguguaaacugcacaagucuggauaugugacagucgcucauaccggccagcacgaucuugugaucccucccaacggguacuuucgguucgacagcugggugaaucaguucuauacgcuggccccuaugggcaacggaaccggcagacgccgggcucucuga

SEQ ID NO: 27736 - RNA, 1623 nt, Artificial Sequence
  derived and/or modified sequence opt5 from VP1__Norovirus__BAS30182
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaaugcugacgcagaccacaaagggcgacgggagcacccggggacacaaggcuacagucuacaccggcuccgccccguuuacgccuaaacucgggucugugcaguucagcacagauaccgaaaacgacuuugagacccaucaaaauacaaaguucacccccguuggagugauucaggauggcuccacaacgcaccgcaacgaaccccagcaauggguccugccuagcuacucuggcagaaaugugccgaacguucaccuugcccccgcuguggccccuaccuuucccggggagcagcuccuguucuuucgguccacaaugccuggauguagcggcuaucccaauauggaccuggauugccugcucccucaggaguggguccagcauuucuaccaagaagcggcucccgcccagucugacguggcccugcuucgcuuugugaacccggauaccgggagaguucuguucgaguguaaacuccacaagagcggauaugucacaguggcucauaccggccagcacgaccuggugaucccucccaauggguacuuucgguucgauuccugggucaaccaguucuauacgcuugccccuaugggcaacggaaccggcagacgccgggcucuguga

SEQ ID NO: 27737 - RNA, 1623 nt, Artificial Sequence
  derived and/or modified sequence opt5 from VP1__Norovirus__BAS30185
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccacaaagggcgacgggagcacccggggacacaaggcuacagucuacaccggcuccgccccguuuacgccuaaacucgggucugugcaguucagcacagacaccgaaaaugauuuugagacccaucaaaacacaaaguucacccccguuggagugauucaggacggcuccacaacgcaccgcaaugaaccccagcaauggguccugccuagcuacucuggcagaaacgugccgaauguucaccuugcccccgcuguggccccuaccuuucccggggagcagcuccuguucuuucgguccacaaugccuggauguagcggcuaucccaacauggaucuggacugccugcucccucaggaguggguccagcauuucuaccaagaagcggcucccgcccagucugauguggcccugcuucgcuuugugaauccggacaccgggagaguucuguucgaguguaaacuccacaagagcggauaugucacaguggcucauaccggccagcacgaucuggugaucccucccaacggguacuuucgguucgacuccugggucaaccaguucuauacgcuugccccuaugggcaauggaaccggcagacgccgggcucuguga

SEQ ID NO: 27738 - RNA, 1623 nt, Artificial Sequence
  derived and/or modified sequence opt5 from VP1__Norovirus__BAS30188
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccacaaagggcgacgggagcacccggggacacaaggcuacagucuacaccggcuccgccccguuuacgccuaaacucgggucugugcaguucagcacagacaccgaaaaugauuuugagacccaucaaaacacaaaguucacccccguuggagugauucacgacggcuccacaacgcaccgcaaugaaccccagcaguggguccugccuagcuacucuggcagaaacgugccgaauguucaucuugcccccgcuguggccccuaccuuucccggggagcaacuccuguucuuucgguccacaaugccuggauguagcggcuaucccaacauggaucuggacugccugcucccucaggaguggguccagcacuucuaccaggaagcggcucccgcccaaucugauguggcccugcuucgcuuugugaauccggacaccgggagaguucuguucgaguguaaacuccauaagagcggauaugucacaguggcucacaccggccagcacgaucuggugaucccucccaacggguacuuucgguucgacuccugggucaaccaguucuauacgcuugccccuaugggcaauggaaccggcagacgccgggcucuguga

SEQ ID NO: 27739 - RNA, 1623 nt, Artificial Sequence; identical to SEQ ID NO: 27691
  derived and/or modified sequence opt5 from VP1__Norovirus__BAS30191

SEQ ID NO: 27740 - RNA, 1623 nt, Artificial Sequence; identical to SEQ ID NO: 27691
  derived and/or modified sequence opt5 from VP1__Norovirus__BAS30194

SEQ ID NO: 27741 - RNA, 1623 nt, Artificial Sequence; identical to SEQ ID NO: 27691
  derived and/or modified sequence opt5 from VP1__Norovirus__BAS30197

SEQ ID NO: 27742 - RNA, 1623 nt, Artificial Sequence; identical to SEQ ID NO: 27691
  derived and/or modified sequence opt5 from VP1__Norovirus__BAS30200

SEQ ID NO: 27743 - RNA, 1623 nt, Artificial Sequence; identical to SEQ ID NO: 27691
  derived and/or modified sequence opt5 from VP1__Norovirus__BAS30203

SEQ ID NO: 27744 - RNA, 1623 nt, Artificial Sequence; identical to SEQ ID NO: 27691
  derived and/or modified sequence opt5 from VP1__Norovirus__BAS30206

SEQ ID NO: 27745 - RNA, 1623 nt, Artificial Sequence
  derived and/or modified sequence opt5 from VP1__Norovirus__BAS30209
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagaggugcccgccccucuuggcacacccgauuucgucgggaaaauucagggagugcugacgcagaccacaaagggcgacggguccacccggggacacaaggcuacaguuuacaccggcagcgccccguuuacgccuaaacucggguccgugcaguucucuacagacaccgaaaacgauuuugagacccaucaaaauacaaaguucacccccgucggagugauccaggacggcagcacaacgcaccgcaacgaaccccagcaauggguucugccuuccuacagcggcagagaugugccgaauguccaccuugcccccgcuguggccccuaccuuucccggggagcagcuccuguucuuucggucuacaaugccuggauguuccggcuaucccaacauggaccuggauugccugcucccucaggagugggugcagcauuucuaccaagaagcggcucccgcccagagcgacguugcccugcuucgcuuugucaauccggauaccgggagagugcuguucgaguguaaacuccacaagucuggauaugugacagucgcucauaccggccagcacgaccuggugauuccucccaacggguacuuucgguucgauagcuggguuaaccaguucuauacgcuugccccuaugggcaauggaaccggcagacgccgggcucuguga

SEQ ID NO: 27746 - RNA, 1623 nt, Artificial Sequence
  derived and/or modified sequence opt5 from VP1__Norovirus__BAS30212
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagagauguuccgaaugugcaccuugcccccgcugucgccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguggcccugcuucgcuuuguuaauccggauaccggaagaguccuguucgaguguaaacuccacaagagcggcuaugugacaguggcucauaccgggcagcacgaccuggucaucccucccaacggcuacuuucgguucgauucuugggugaaccaguucuauacgcuugccccuaugggaaauggcaccgggagacgccgggcucuguga

SEQ ID NO: 27747 - RNA, 1623 nt, Artificial Sequence
  derived and/or modified sequence opt5 from VP1__Norovirus__BAS30215
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugccgaacguucaccuugcccccgcuguggccccuaccuuucccggggagcagcuccuguucuuucggucuacaaugccuggauguuccggcuaucccaauauggaucuggacugccugcucccucaggaguggguccagcauuucuaccaagaagcggcucccgcccagagcgauguggcccugcuucgcuuugugaacccggacaccgggagaguucuguucgaguguaaacuccacaagucuggauaugucacaguggcucauaccggccagcacgaucuggugaucccucccaacggguacuuucgguucgacagcugggucaaucaguucuauacgcuugccccuaugggcaacggaaccggcagacgccgggcucuguga

SEQ ID NO: 27748 - RNA, 1623 nt, Artificial Sequence; identical to SEQ ID NO: 27747
  derived and/or modified sequence opt5 from VP1__Norovirus__BAS30218

SEQ ID NO: 27749 - RNA, 1623 nt, Artificial Sequence
  derived and/or modified sequence opt5 from VP1__Norovirus__BAS30221
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaguccagggagugcugacgcagaccacaaagggcgacgggagcacccggggacacaaggcuacaguuuacaccggcuccgccccguuuacgccuaaacucgggucugugcaguucagcacagacaccgaaaaugauuuugagacccaucaaaacacaaaguucacccccgucggagugauccaggacggcuccacaacgcaccgcaaugaaccccagcaauggguucugccuagcuacucuggcagaaacgugccgaauguccaccuugcccccgcuguggccccuaccuuucccggggagcagcuccuguucuuucgguccacaaugccuggauguagcggcuaucccaacauggaucuggacugccugcucccucaggagugggugcagcauuucuaccaagaagcggcucccgcccagucugauguugcccugcuucgcuuugucaauccggacaccgggagagugcuguucgaguguaaacuccacaagagcggauaugugacagucgcucauaccggccagcacgaucuggugauuccucccaacggguacuuucgguucgacuccuggguuaaccaguucuauacgcuugccccuaugggcaauggaaccggcagacgccgggcucuguga

SEQ ID NO: 27750 - RNA, 1623 nt, Artificial Sequence
  derived and/or modified sequence opt5 from VP1__Norovirus__BAS30224
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccgugcugaccgucgaagagaugacaaacuccagauuuccuaucccccuugagaagcuguucaccgggccgagcucugccuucgugguucagccucagaauggacgguguacaaccgacggcgugcuccuggggacgacacaacugucccccgucaacauuugcaccuuucgcggagaugugacacauaucgcuggcagcagaaauuacaccaugaaccucgcgucucugaauuggaacaauuaugacccuaccgaagagauccccgccccucuuggcacacccgauuucgucgggaaaauucagggaaugcugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauccaggacggcagcacaacgcaccgcaacgaaccccagcaaugggugcugccuuccuacagcggcagaaauguuccgaacgugcaccuugcccccgcugucgccccuaccuuucccggggagcagcuccuguucuuucggucuacaaugccuggauguuccggcuaucccaauauggaucuggacugccugcucccucaggagugggugcagcauuucuaccaagaagcggcucccgcccagagcgauguggcccugcuucgcuuuguuaacccggacaccgggagaguccuguucgaguguaaacuccacaagucuggauaugugacaguggcucauaccggccagcacgaucuggucauuccucccaacggguacuuucgguucgacagcugggugaaucaguucuauacgcuugccccuaugggcaacggaaccggcagacgccgggcucuguga

SEQ ID NO: 27751 - RNA, 1623 nt, Artificial Sequence
  derived and/or modified sequence opt5 from VP1__Norovirus__BAS30227
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcgccaaaccuuucaccguucccauccugacgguggaagagaugaccaauagcagauuuccuauuccccuugagaagcuguucacagggccgucuuccgcuuucgucgugcagccucagaacggacgguguaccacagacggcguucuccuggggaccacgcaacugagccccgugaauaucugcacauuucgcggagaugucacccauaucgcgggcucuagaaacuacacaaugaaucucgccuccccuaacuggaauaacuaugaccccaccgaagagauuccugcuccccugggcaccccggauuucguggggaaaauccagggaaugcuuacacagacgaccaagggcgacgggagcacacggggacacaaggccaccgucuacacaggcuccgccccuuuuacccccaaacuggggucugugcaguucagcacggacacagaaaaugauuuugagacccaucaaaacaccaaguucacacccguuggagugauucaggacggcuccaccacacaccgcaaugaaccucagcaauggguccucccgagcuacucuggcagaaacgugcccaauguucaccuggcuccugccguggcgcccacguuuccuggggagcagcuucuguucuuucgguccaccaugcccggauguagcggcuauccuaacauggaucucgacugccugcugccccaggaguggguccagcauuucuaccaagaagcugccccggcccagucugauguggcucuccugcgcuuugugaauccugacacagggagaguucuuuucgaguguaaacugcacaagagcggauaugucaccguggcccauacaggccagcacgaucucgugauucccccuaacggguacuuucgguucgacuccugggucaaccaguucuauacccuggcucccaugggcaauggaacgggcagacgccgggcccuuuga

SEQ ID NO: 27752 - RNA, 1623 nt, Artificial Sequence
  derived and/or modified sequence opt5 from VP1__Norovirus__BAS30230
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacagcuacgccgggggauucgaaguccaggugauccuugcuggcaaugccuuuacagcgggcaaaauuaucuucgccgcuguuccucccaacuuuccuacggaggggcugucccccucucaggugaccauguucccgcauaucauugucgacgugagacaacucgagccugugcugaucccccugccugauguccggaauaacuuuuaucacuacaaucagagcaacgacuccacaauuaagcucaucgccaugcuguauacaccccuucgcgcuaacaaugccggagaagauguuuucaccgugagcugcagagugcugacccggcccucuccugacuuugauuucauuuuucucgucccgcccacaguggagucccgcaccaaaccuuucacgguucccauccugaccguggaagagaugacaaacagcagauuuccuauuccccuugagaagcuguucaccggcccgucuuccgccuucgucgugcagccucagaaugggcgguguacaaccgacggaguucuccugggcacgacacaacugagccccgugaacaucugcaccuuucgcggggaugucacacauaucgcuucuuccagaaauuacaccaugaaccucgcgagccugaauuggaacaauuaugacccuaccgaagagauucccgccccucuuggaacacccgauuucgugggcaaaauccagggcaugcugacgcagaccacaaagggggacggauccacccggggccacaaggcuacagucuacaccgggucugccccguuuacgccuaaacucggaagcgugcaguucuccacagacaccgaaaacgauuuugagacccaucaaaauacaaaguucacccccguuggcgugauucaggacgggagcacaacgcaccgcaacgaaccccagcaauggguccugccuucuuacuccggaagaaaugugccgaacguucaccuugcccccgcuguggccccugcguuucccggcgagcagcuccuguucuuucggagcaccaugccuggcuguucuggguaucccaauauggaucuggacugccugcucccucaggaguggguccagcauuucuaccaagaagcugcccccgcccagagcgauguggcucugcuucgcuuugugaacccggacacaggaagaguucuguucgaguguaaacuccacaaguccggcuaugucaccguggcccauacagggcagcacgaucuggugaucccucccaacggauacuuucgguucgacucuugggucaaucaguucuauacccuugcuccuaugggcaacgggacgggcagacgccgggcccuguga

SEQ ID NO: 27753 - RNA, 1623 nt, Artificial Sequence; identical to SEQ ID NO: 27081
  derived and/or modified sequence opt5 from VP1__Norovirus__BAS30233

SEQ ID NO: 27754 - RNA, 1623 nt, Artificial Sequence; identical to SEQ ID NO: 27747
  derived and/or modified sequence opt5 from VP1__Norovirus__BAS30236

SEQ ID NO: 27755 - RNA, 1623 nt, Artificial Sequence; identical to SEQ ID NO: 27747
  derived and/or modified sequence opt5 from VP1__Norovirus__BAS30239

SEQ ID NO: 27756 - RNA, 1623 nt, Artificial Sequence
  derived and/or modified sequence opt5 from VP1__Norovirus__BAS30242
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagaggugcccgccccucuuggcacacccgauuucgucgggaaaauucagggagugcugacgcagaccacaaagggcgacggguccacccggggacacaaggcuacaguuuacaccggcagcgccccguuuacgccuaaacucggguccgugcaguucucuacagacaccgaaaacgauuuugagacccaucaaaauacaaaguucacccccgucggagugauccaggacggcggcacaacgcaccgcaacgaaccccagcaauggguucugccuagcuacuccgggagagaugugccgaauguccaccuugcccccgcuguggccccuaccuuucccggagagcagcuccuguucuuucggagcacaaugccuggcuguucuggguaucccaacauggaccuggauugccugcucccucaggagugggugcagcauuucuaccaagaagcggcucccgcccaguccgacguugcccugcuucgcuuugucaauccggauaccggaagagugcuguucgaguguaaacuccacaagagcggcuaugugacagucgcucauaccgggcagcacgaccuggugauuccucccaacggcuacuuucgguucgauucuuggguuaaccaguucuauacgcuugccccuaugggaaauggcaccgggagacgccgggcucuguga

SEQ ID NO: 27757 - RNA, 1620 nt, Artificial Sequence
  derived and/or modified sequence opt5 from VP1__Norovirus__BAS30245
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuaucccucccaacuuuccuacggagggacugagccccucccagguuaccauguucccgcauauuguggucgacgugagacaacucgagccugugcugaucccccugccugauguccggaauaacuuuuaucacuacaaucagacaaaggaaucuaccauuaaacucguugccaugcuguauacaccccuucgcgcuaacaacgccggcgacgauguguucaccgugagcugcagaguccugacacggcccuccccugacuuugauuucaucuuucucgugccgcccagcguugagucucgcaccaagccuuucacggugcccauucugaccgucgaagagaugacaaauuccagauuuccuaucccccuugagcggcuguucaccgggccgagcucugccuucgugguucagccucagaacggacgcuguacaaccgacggcgugcuccuggggacgacacaacugucccccgucaauauuugcaccuuuagaggagaugugacacgggucagcaccacccauguguacgaaaugaaccucgcuucucagaauuggaacaauuaugacccuacagaggaaguucccgcgccucugggcacgcccgauuucgugggcaaaauccaggggguccuuacccagacaacccgcacagacggauccaccagagcccacaaggcuacggugagcacaggcgccgccgacuuuaccccgaagcugggguccauccgguucgagaccacaaccaaccgcgaucucgaaacacaucaaaauacgaaauuuaccccuguuggagugauucaggacggcgauaaccaccagaaugagccccaacaguggagacugcccggguacgcuggacgggacgcccacaacguccaucuugcgccugcuguggccccgacauuccccggcgagcagcugcucuuuuucagaucuaccaugccuggcuguagcggguaccccaauaugaaccuggauugccugcucccucaggaaugggugcaacacuuuuaucaggaggccgcucccgcccaguccgacguugcucugcuucgcuucgucaauccugauacaggacgggugcuguuugaauguaagcuccauaaaagcggcuaccugaccguggcccacacggggcccuaugaccuugucaucccgccuaacggauacuucagauuugauucuugggugaaccaguucuauacccuggcgcccaugggcaaugggacaggccgccggagagcccucuga

SEQ ID NO: 27758 - RNA, 1623 nt, Artificial Sequence
  derived and/or modified sequence opt5 from VP1__Norovirus__BAS30248
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccauuguguacacgggauccgcugauuuugccccuaagcugggcagaguucaauucgccacagacaccgauaaugacuuuggggcuaaucagaacaccaaauucacacccgugggagucauccaggauggcgacaccgcccaucggaaugagccccaacagugggugcucccuucuuacagcggccgcaacucccacaauguucaccuggcgccggcuguggcccccacauuuccuggggaacagcuucuguucuuuagaagcacgaugcccggauguucuggcuauccuaacauggaucucgacugccugcugccccaggaguggguccaauacuucuaucaggaagccgcuccugcccaguccgauguggcucuccugcgguuugugaaucccgacaccgggagaguucuuuucgaguguaagcugcauaaaagcggauacgucacaguggcccacaccggccagcaugaucucgugauuccgccuaacggguauuuucgcuucgacucuugggucaaccaauucuacacacuggcgcccaugggcaauggaaccggccggagacgcgcccuuuga

SEQ ID NO: 27759 - RNA, 1623 nt, Artificial Sequence; identical to SEQ ID NO: 27022
  derived and/or modified sequence opt5 from VP1__Norovirus__BAS30251

SEQ ID NO: 27760 - RNA, 1626 nt, Artificial Sequence
  derived and/or modified sequence opt5 from VP1__Norovirus__BAS30254
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcaaggugucucccaucccgcuuaaaaagcuguuuaccgggccuuccagcgccuucguugugcagccccagaacggaagauguacaaccgauggcguccuccuggggacgacacaacugucuccugugaauauuugcaccuuccggggagacgucacacauauccccggcucccgcaacuacaccaugaaucucgccagccagaacuggaacuccuaugauccuaccgaggagauccccgcuccgcugggcacaccugacuuuguggggaagauucagggaguucuuacgcagaccacaagaaccaauggcucuacacgggggcacaaagcgaccguguacacgggaagcgccgacuucucccccaagcugggccgcguccaauuugcuacagauaccgacaaugauuucgaaaccaaccagaauacaaaauuuacccccguggggguuauccaggacggaagcacaacgccuagaaacgagccgcaacagugggugcuccccucuuacuccggccggaauauucauaacguccaccuggccccugccguggcucccaccuucccuggcgaacagcuucuguuuuuccgcagcacaaugcccggguguucuggauauccuaauauggaucucgacugccugcugccccaggagugggugcaauacuuuuaucaggaagccgcgccggcucagagcgauguugcccuccugagauucgucaacccugacaccggccgggugcuuuuugaguguaagcugcacaaauccggguacgugacagucgcccauaccggacagcacgaucucgugauucccccuaacggcuauuucagauuugacucuuggguuaaucaauucuacacgcuggcucccauggggaacggcaccggacgccggagagcccuuuga

SEQ ID NO: 27761 - RNA, 1623 nt, Artificial Sequence; identical to SEQ ID NO: 27045
  derived and/or modified sequence opt5 from VP1__Norovirus__BAS30257

SEQ ID NO: 27762 - RNA, 1623 nt, Artificial Sequence; identical to SEQ ID NO: 26522
  derived and/or modified sequence opt5 from VP1__Norovirus__BAS30260

SEQ ID NO: 27763 - RNA, 1623 nt, Artificial Sequence
  derived and/or modified sequence opt5 from VP1__Norovirus__BAS30263
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaauccgagacgaaaccuuucuuuuuccccguucugaccguggaagagaugacaaauagccgcuucccuaucccccuugagaagcuguuuaccgggccgucuuccgccuucgucgugcagccucagaacggaagauguacaaccgauggcguucuccuggggacgacacaacugagccccgugaauauuugcaccuuucggggagacgucacacauaucccuggcucucgcaacuacaccaugaaucucgccucccagaacuggaauagcuaugaucccaccgaagagaucccugcuccccugggcacaccggacuucguggggaaaauucagggaguccuuacgcagaccacaagaaccaacggcuccacacgggggcacaaggcgaccguguacacgggaucugccgacuuuagcccuaagcugggccgcguucaauucgcuacagauaccgacaaugauuuugaaaccaaccagaauacaaaauucacccccgugggggucauccaggacggauccacaacgcccagaaacgagccucaacagugggugcucccgagcuacucuggccggaauauucauaacguucaccuggcccccgccguggcuccuaccuuucccggcgaacagcuucuguucuuucgcuccacaaugccuggguguagcggauaucccaauauggaucucgacugccugcugccucaggaguggguccaauacuucuaucaggaggccgcgcccgcucagucugauguggcccuccugagauuugugaacccggacaccggccggguucuuuucgaauguaagcugcacaaaagcggguacgucacaguggcccauaccggacagcacgaucucgugaucccucccaacggcuauuucagauuugacuccugggucaaucaauucuacacgcuggcuccuauggggaacggcaccggacgccggagagcccuuuga

SEQ ID NO: 27764 - RNA, 1623 nt, Artificial Sequence; identical to SEQ ID NO: 27045
  derived and/or modified sequence opt5 from VP1__Norovirus__BAS30266

SEQ ID NO: 27765 - RNA, 1623 nt, Artificial Sequence; identical to SEQ ID NO: 27045
  derived and/or modified sequence opt5 from VP1__Norovirus__BAS30269

SEQ ID NO: 27766 - RNA, 1623 nt, Artificial Sequence; identical to SEQ ID NO: 27045
  derived and/or modified sequence opt5 from VP1__Norovirus__BAS30272

SEQ ID NO: 27767 - RNA, 1623 nt, Artificial Sequence
  derived and/or modified sequence opt5 from VP1__Norovirus__BAS30275
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucuucccucuggcccgcaaagucaagggguaugcuggaggcuuugaagugcagguuauccuugccggcaaggcuuuccccgccgggaaaauuaucuuugcggccucuccucccaacuucccgacggagggacugagcccuucccaggugaccauguuuccccacaucauugucgacgugagacaacucgagccugugcugaucccccugcccgauguccggaauaacuucuaccauuauaaucagucuaacgacagcacaauuaaacucaucgcuaugcuguacaccccucuucgcgccaauaacgcuggcgaagauguuuuuacaguguccugcagagugcugacccggccgagccccgacuucgauuuuauuuuccucgucccucccacaguggagucucgcaccaagccuuuuuccguucccauccugacgguggaagagaugaccaacagcagauucccgauuccucuugagaagcuguucacagggcccucuuccaccuuugucgugcagccucagaauggacgguguacaaccgacggcguucuccuggggacgacacaacugagccccgugaacaucugcaccuuccgcggagaugucacacacaucgccggcucuagaaauuauaccaugaaccucgccucccagaauuggaacagcuacgacccuaccgaagagauucccgcuccgcugggcacaccugauuuuguggggaaaauccagggaguccuuacgcagaccacacggcgcgacggcuccaccagagggcauaaggcgacaguguauaccggaucugccgacuucagccccaaacugggccggguucaauuugcuacggauacagacaaugauuucgacacccaccagaacaccaaguuuacacccgugggggucauucaggauggaggcaccgcccaucgcaaugaaccucaacagugggugcucccguccuacagcggcagaaacacacacaauguucaccuggcccccgcuguggccccuacguuccccggggagcagcuucuguuuuuccggucuaccaugccuggauguuccggcuaccccaacauggaccucgauugccugcugccucaggaauggguccaauauuuuuaccaggaggcggcucccgcccagagcgacguggcccuccugagauucgugaauccggauacagggcgcguucuuuuugaguguaaacugcauaagucuggauaugucaccguggcucacacaggccagcaugaccucgugaucccucccaacggguacuuccgguucgauagcugggucaaucaauuuuauacccuggccccuaugggcaacggaacgggcagacgccgggcucuuuga

SEQ ID NO: 27768 - RNA, 1623 nt, Artificial Sequence; identical to SEQ ID NO: 27045
  derived and/or modified sequence opt5 from VP1__Norovirus__BAS30278

SEQ ID NO: 27769 - RNA, 1623 nt, Artificial Sequence; identical to SEQ ID NO: 26518
  derived and/or modified sequence opt5 from VP1__Norovirus__BAS30284

SEQ ID NO: 27770 - RNA, 1623 nt, Artificial Sequence
  derived and/or modified sequence opt5 from VP1__Norovirus__BAS30287
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacagcacgaucucgucauucccccuaacggcuauuuucgcuucgacuccuggaucaaucaauucuacacgcuggcucccauggggaacggcaccggacggagacgcgcccuuuga

SEQ ID NO: 27771 - RNA, 1623 nt, Artificial Sequence
  derived and/or modified sequence opt5 from VP1__Norovirus__BAS30290
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcagaccacacggaccaauggcagcacacgcgggcacaaggcgaccguuuacacgggauccgccgacuuuagcccgaagcugggcagagugcaauucgcuacagauaccgacaaugauuuugagaccaaccagaauacaaaauucaccccugucggggugauccaggacggaucuacaacgccccggaacgaaccccaacaguggguucucccuuccuacagcggccgcucuauucauaaugugcaccuggccccggccgucgcucccaccuuuccuggcgagcagcuucuguucuuuagaagcacaaugcccggguguuccggauauccuaacauggaucucgacugccugcugccccaggaaugggugcaauacuucuaucaggaggccgcgccugcucagucugauguggcccuccugcgguuuguuaaucccgacaccggcagaguccuuuucgaguguaagcugcacaaaagcggguacgugacaguggcccauaccggacagcacgaucucgucaucccgccuaacggcuauuuucgcuucgacuccugggugaaccaauucuacacgcuggcucccauggggaauggcaccggacggagacgcgcccuuuga

SEQ ID NO: 27772 - RNA, 1623 nt, Artificial Sequence
  derived and/or modified sequence opt5 from VP1__Norovirus__BAS30293
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucuagaaacuacaccaugaaucucgccucccagaacuggaauagcuaugaucccacagaggaaauuccugcuccccugggcacgccggacuucguggggaaaauccagggaguccuuacccagacaacccggacagacggcuccacccgcgggcacaaggcgacgguguacacaggaucugccgauuuuagcccuaagcugggcagaguucaauucgcuaccgacaccgauaacgacuuugaugccaaucagaacacaaaauucacccccgugggggucauucaggacggaggcacagcccaucggaaugagccccaacagugggugcucccuuccuacagcggccgcaacacgcacaauguucaccuggcuccggccguggcgcccaccuuuccuggggaacagcuucuguucuuuagaucuacaaugcccggauguuccggcuauccuaacauggaucucgacugccugcugccccaggaguggguccaauacuucuaucaggaagcugccccugcccagagcgauguggcucuccugcgguuugugaaucccgacaccgggagaguucuuuucgaguguaagcugcauaaaucuggauacgccacagucgcucacaccggccagcaugaucucgugaucccgccuaacggguauuuucgcuucgacagcugggugaaccaauucuacacgcuggcccccaugggcaauggaaccggccggagacgcgcgcuuuga

SEQ ID NO: 27773 - RNA, 1623 nt, Artificial Sequence
  derived and/or modified sequence opt5 from VP1__Norovirus__BAS30296
augaagauggccagcaaccacgugaaucccuccgacggcucuaccgcuaaccuggucccugagguuaauaacgaagugauggcccucgagccgguggucggggcggcuaucgccgcccccguggcuggacagcaaaauguuauugauccuuggaucagaaacaauuucgugcaggcccccggcggggaauuuacagucagcccucggaacgcucccggagagauucugugguccgccccucuuggcccggaccugaaucccuaccucucucaucuggcgcgcauguauaacggguacgccggaggcuucgaagugcagguuauccuugcuggcaaugccuuuacggcugggaaaauuaucuucgccgcggugccucccaacuuuccuaccgagggacugagccccucccaggucacaauguucccgcacaucauuguggaugugagacaacucgagccuguccugaucccccugccugacguucggaauaacuuuuaucauuacaaucagucuaacgaucccaccauuaagcucaucgccaugcuguauacaccccuucgcgcuaacaaugccggcgacgauguguucaccgugagcugcagaguccugacacggccuuccccggacuuugauuucauuuuucucgugcccccuaccguugaaagccgcacgaaacccuucucugugccuguccugaccguggaggaaaugacaaacuccagauuucccaucccgcuugagaagcuguucaccgggccuagcucugcuuucguugugcagccccagaauggacgguguacaaccgacggcguccuccuggggacgacacaacuguccccugugaacauuugcaccuuucgcggagaugucacacacauccccggcagcagaaauuacaccaugaaccucgccucucagaauuggaacuccuaugacccuaccgaggaaauccccgccccgcugggcacaccugauuucguggggaaaauucagggaguucuuacgcagaccacacggaccaauggcagcacacgcgggcauaaggcuaccguguacacgggauccgcggacuuuucucccaagcugggcagaguccaauucgccacagacaccgauaacgacuuugagaccaaucagaacacaaaauucacccccguggggguuauccaggauggaagcacaacgccucggaaugaaccgcaacagugggugcuccccuccuacagcggccgcaacauucacaauguccaccuggcuccugccguggcccccaccuuuccuggcgagcagcuucuguucuuuagaucuaucaugcccggguguuccggauauccuaacauggaccucgauugccugcugccccaggaaugggugcaauacuucuaucaggaggcugccccggcgcagagcgacguugcucuccugcgguuugucaacccugauacaggcagagugcuuuucgaguguaagcugcauaaaucuggguacgugaccgucgcccacacaggacagcaugaccucgugauucccccuaauggcuauuuucgcuucgauagcuggguuaaccaauucuacacccuggcccccauggggaauggcacgggacggagacgcgcucuuuga

SEQ ID NO: 27774 - RNA, 1623 nt, Artificial Sequence; identical to SEQ ID NO: 27023
  derived and/or modified sequence opt5 from VP1__Norovirus__BAS30299

SEQ ID NO: 27775 - RNA, 1623 nt, Artificial Sequence
  derived and/or modified sequence opt5 from VP1__Norovirus__BAS30302
augaagauggccagcuccgacgcuaaccccuucgauggcucuaccgccaaucuggugccugaggucaacaaugaaguuauggcgcucgagccgguggugggggcugccaucgccgcucccgucgccggacagcaaaacgugaucgacccuuggaucagaaauaacuuuguucaggcucccggcggggaguucacagugagcccucggaaugcccccggagaaauucugugguccgcgccucuuggcccggaucugaaccccuaccucucucaccugagccgcauguauaauggguacgccggaggcuuugaaguccaggugauccuugcuggcaacgccuucacggcugggaaaauuaucuuugccgcgguuccucccaauuucccuaccgagggacugucccccucucaggugacaauguuuccgcauaucauugucgacgugagacaacucgagccugugcugaucccccugccugauguccggaacaauuucuaucacuacaaccagagcaaugaccccaccauuaagcucaucgccaugcuguauacaccccuucgcgcuaacaacgccggcgaugacguuuuuaccguguccugcagagugcugacacggccuagcccggauuucgacuuuauuuuccucgugcccccuaccgucgaaucucgcacgaaacccuuuuccguuccugugcugaccgucgaggaaaugacaaauagcagauuccccaucccgcuugagaagcuguucaccgggccuucuuccgcuuuugugguucagccccagaacggacgguguacaaccgauggcgugcuccuggggacgacacaacugagcccugucaauauuugcaccuuccgcggagacgugacacauauccccggcucuagaaacuacaccaugaaucucgccucccagaacuggaauagcuaugauccuaccgaggaaauccccgccccgcugggcacaccugacuuugucgggaaaauucagggagugcuuacgcagaccacacggaccaacggcuccacacgcgggcacaaggcuaccguuuacacgggaucugcggacuucagccccaagcugggcagagugcaauuugccacagauaccgacaaugauuucgagaccaaccagaauacaaaauuuacccccgucggggugauccaggacggauccacaacgccucggaacgaaccgcaacaguggguucuccccagcuacucuggccgcaauauucauaacgugcaccuggcuccugccgucgcccccaccuucccuggcgagcagcuucuguuuuucagauccacaaugcccggguguagcggauauccuaauauggaucucgacugccugcugccccaggaaugggugcaauacuuuuaucaggaggcugccccggcgcagucugauguggcucuccugcgguucguuaacccugacaccggcagaguccuuuuugaguguaagcugcacaaaagcggguacgugacaguggcccauaccggacagcacgaucucgucauucccccuaacggcuauuuccgcuucgacuccugggugaaucaauuuuacacgcuggcccccauggggaacggcaccggacggagacgcgcucuuuga

SEQ ID NO: 27776 - RNA, 1623 nt, Artificial Sequence
  derived and/or modified sequence opt5 from VP1__Norovirus__BAS30305
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucuggcacgcuugggccugaucugaacccguaccucagccaccuggcgcgcauguauaauggauacgccggcggcuucgaaguccaggugauccuugcugggaacgccuuuaccgcuggaaaaauuaucuucgccgcgguucccccuaauuuucccacagagggccuguccccuucucaggugaccauguucccccauaucauugucgacgugagacaacucgagccggugcugaucccucugcccgauguccggaacaauuuuuaucacuacaaccagagcaaugacccuacaauuaagcucaucgccaugcuguauacaccccuucgcgcuaacaacgccggggaugacguuuucaccguguccugcagagugcugacccggcccagcccugauuuugacuucauuuuucucgucccgcccacgguggaaucucgcaccaaaccuuucuccguucccgugcugacagucgaggaaaugaccaauagcagauuuccuaucccccuugagaagcuguucacaggaccgucuuccgcuuucgugguucagccucagaacggccgguguaccacggauggggugcuccugggaacaacccaacugagccccgucaauauuugcacauuucgcggcgacgugacccauaucccuggcucuagaaacuacaccaugaaucucgccucccagaacuggaauagcuaugaucccacagaggaaaucccugcuccccuggggacgccggacuucgucggaaaaauucagggcgugcuuacccagacaacccggacaaacggguccacccgcggacacaaggccacgguuuacacaggcucugcggacuuuagcccuaagcuggggagagugcaauucgccaccgauaccgacaaugauuuugagacaaaccagaauaccaaauucacacccgucggagugauccaggacggcuccacgacaccccggaacgaaccucaacaguggguucucccgagcuacucuggccgcaauauucauaacgugcaccuggcucccgccgucgccccuaccuuucccggggagcagcuucuguucuuuagauccaccaugccuggauguagcggcuaucccaauauggaucucgacugccugcugccucaggaaugggugcaauacuucuaucaggaggcugcccccgcgcagucugauguggcucuccugcgguuuguuaacccggacacagggagaguccuuuucgaguguaagcugcacaaaagcggauacgugaccguggcccauacgggccagcacgaucucgucaucccucccaacggguauuuucgcuucgacuccugggugaaucaauucuacacccuggccccuaugggcaacggaacaggccggagacgcgcucuuuga

SEQ ID NO: 27777 - RNA, 1626 nt, Artificial Sequence
  derived and/or modified sequence opt5 from VP1__Norovirus__BAS30308
augaagauggccagcaacgacgugaaucccuccgauggcucuaccgcuaaccuggucccugagguuaauaacgaagugauggcccucgagccgguggucggggcggcuaucgccgcccccguggcuggacagcaaaauguuauugacccuuggaucagaaacaauuucgugcaggcccccggcggggaauuuacagucagcccucggaacgcucccggagagauucugugguccgccccucuuggcccggaucugaaucccuaccucucucaccuggcgcgcauguauaacggguacgccggaggcuucgaagugcagguuauccuugcuggcaaugccuuuacggcuguggucagaauuaucuucagcgccgugccucccaacuuuccuaccgaggggcugucccccucucaggugacaauguucccgcauaucauugucgacguucggcaacucgagccugugcugaucccccugccugaugugcgcaauaacuuuuaucacuacaaucagagcaacgacuccaccauuaaacucaucgcgaugcuguauacaccccuuagagccaacaaugcuggagaugacgucuucaccgugagcugccggguucugacacgccccucuccugauuuugacuucauuuuucucgugccgcccaccgucgaauccagaacgaagccuuucagcgugcccguucugaccguggaggaaaugacaaacucucgguuuccuaucccccuugagaaacuguucaccggcccguccagcgccuucgucgugcagccucagaaugggcgcuguacaaccgauggaguccuccugggcacgacacaacugucucccgugaacauuugcaccuuuagaggggacguuacacauaucuccggaagccggaauuacaccaugaaccucgcuucccagaauuggaacucuuaugauccuaccgaggaaauccccgccccucugggcacacccgacuucgugggcaagauucaggggguccuuacgcagaccacacgcaccaauggaagcacaagaggccacaaagccaccguguacacgggguccgcugacuuuagcccgaagcugggacggguucaauucgcgacagauaccgacaacgauuuugagaccaaucagaacacaaaguucaccccugugggcgucauccaggacgggucuacaacgccccgcaaugaaccccaacagugggugcucccuuccuacagcggaagaaacauucauaaugugcaccuggccccggcuguugcccccaccuuuccuggcgagcagcuucuguucuuucggucuacaaugcccggcuguagcggguauccuaacauggaucucgacugccugcugccccaggaauggguccaauacuucuaucaggaggccgcuccugcccaguccgauguggcgcuccugagauuugugaaccccgacaccggacgcguccuuuucgaguguaaacugcacaagucuggcuacgugacaguugcucauaccgggcagcacgaucucgugaucccgccuaauggauauuuucgguucgacagcugggucaaccaauucuacacgcuggcccccaugggcaaugggaccggcagacgccgggcccuuuga

SEQ ID NO: 27778 - RNA, 1623 nt, Artificial Sequence; identical to SEQ ID NO: 26482
  derived and/or modified sequence opt5 from VP1__Norovirus__BAS30311

SEQ ID NO: 27779 - RNA, 1623 nt, Artificial Sequence
  derived and/or modified sequence opt5 from VP1__Norovirus__BAS30314
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaacaaucagaacaccaaauucacacccgucggggugauccaggacggauccaccacaccucggaaugaaccgcaacaguggguucuccccagcuacucuggccgcaacauucauaaugugcaccuggccccugccgucgcucccacguuuccuggcgagcagcuucuguucuuuagauccaccaugcccggguguagcggauauccuaacauggaucucgacugccugcugccccaggaaugggugcaauacuucuaucaggaggccgcgccggcucagucugauguggcccuccugcgguuuguuaacccugacacaggcagaguccuuuucgaguguaagcugcacaaaagcggguacgugaccguggcccauacaggacagcacgaucucgucauucccccuaauggcuauuuucgcuucgacuccugggugaaccaauucuacacccuggcucccauggggaauggcacgggacggagacgcgcccuuuga

SEQ ID NO: 27780 - RNA, 1623 nt, Artificial Sequence
  derived and/or modified sequence opt5 from VP1__Norovirus__BAS30317
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccacauucgucgugcagccccagaacggacgguguaccacggauggcguucuccuggggacaacccaacugagcccugugaauaucugcacauuucgcggagacgucacccauaucgccggcucuagaaacuacaccaugaaucucgccucccagaacuggaauagcuaugaucccacagaggaaauuccugcuccccugggcacgccggacuucguggggaaaauccagggaguccuuacccagacaacccggacagacggcuccacccgcgggcacaaggcgacgguguacacaggaucugccgauuuuagcccuaagcugggcagaguucaauucgcuaccgacaccgauaacgacuuugaugccaaucagaacacaaaauucacccccgugggggucauucaggacggaggcacagcccaucggaaugagccccaacagugggugcucccuuccuacagcggccgcaacacgcacaauguucaccuggcuccggccguggcgcccaccuuuccuggggaacagcuucuguucuuuagaucuacaaugcccggauguuccggcuauccuaacauggaucucgacugccugcugccccaggaguggguccaauacuucuaucaggaagcugccccugcccagagcgauguggcucuccugcgguuugugaaucccgacaccgggagaguucuuuucgaguguaagcugcauaaaucuggauacgucacaguggcccacaccggccagcaugaucucgugaucccgccuaacggguauuuucgcuucgacagcugggucaaccaauucuacacgcuggcucccaugggcaauggaaccggccggagacgcgcccuuuga

SEQ ID NO: 27781 - RNA, 1623 nt, Artificial Sequence; identical to SEQ ID NO: 27780
  derived and/or modified sequence opt5 from VP1__Norovirus__BAS30320

SEQ ID NO: 27782 - RNA, 1623 nt, Artificial Sequence
  derived and/or modified sequence opt5 from VP1__Norovirus__BAS30323
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaggcacaacgccccggaacgaaccucaacaguggguucucccgagcuacucuggccgcaauauucauaacgugcaccuggcccccgccgucgcuccuaccuuucccggggagcagcuucuguucuuuagauccacaaugccuggauguagcggcuaucccaauauggaucucgacugccugcugccucaggaaugggugcaauacuucuaucaggaggccgcgcccgcucagucugauguggcccuccugcgguuuguuaacccggacaccgggagaguccuuuucgaguguaagcugcacaaaagcggauacgugacaguggcccauaccggccagcacgaucucgucaucccucccaacggguauuuucgcuucgacuccugggugaaucaauucuacacgcuggcuccuaugggcaacggaaccggccggagacgcgcccuuuga

SEQ ID NO: 27783 - RNA, 1623 nt, Artificial Sequence
  derived and/or modified sequence opt5 from VP1__Norovirus__BAS30326
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccgggccuuccagcacauucgucgugcagccccagaacggacgguguaccacggauggcguucuccuggggacaacccaacugucuccugugaauaucugcacauuucgcggagacgucacccauaucaccggcucccacaacuacacaaugaaucucgcuagccagaacuggaacuccuaugaucccacggaggaaauuccugcuccccugggcaccccggacuucguggggaaaauccagggaguccuuacacagaccacaagaaccgacggcucuacgcgggggcauaaggccacaguguacaccggaagcgccgaguuuuccccuaagcugggccgcguucaauucgcgaccgauacaaauaaugacuuugaugccaaccagaauaccaaauucacacccgugggggucauucaggacggaggcacgacccacagaaacgaaccccaacagugggugcucccuagcuacucuggccggaauacacacaacguucaucuggcuccggccguggcccccaccuuuccuggggagcagcuucuguucuuucgcuccacaaugcccggauguagcggcuauccuaauauggaucucgacugccugcugccccaggaauggguccaacacuucuaccaggaggcugccccugcgcagucugauguggcucuccugagauuugugaaccccgacaccgggcggguucuuuucgaguguaagcugcauaaaagcggauaugucacgguggcccacaccggccagcacgaucucgugaucccgccuaacggguacuuuagauucgacuccugggucaaucaauucuauacacuggcccccaugggcaacggaaccggccgccggagagcucuuuga

SEQ ID NO: 27784 - RNA, 1623 nt, Artificial Sequence; identical to SEQ ID NO: 27045
  derived and/or modified sequence opt5 from VP1__Norovirus__BAS30329

SEQ ID NO: 27785 - RNA, 1623 nt, Artificial Sequence
  derived and/or modified sequence opt5 from VP1__Norovirus__BAS30332
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccaccccgcuugagaagcuguucacagggccuuccagcaccuucgucgugcagccccagaacggacgguguacgacagauggcguucuccuggggaccacacaacugucuccugugaauauuugcaccuuucgcggagacgucacccauaucacaggcucccacaacuacacgaugaaucucgcuagccagaacuggaacuccuaugaucccaccgaggaaaucccugcuccccugggcacaccggacuucguggggaaaauucagggaguccuuacccagacaaccagaacggacggcucuacacgggggcauaaggccaccguguacaccggaagcgccgaguuuuccccuaagcugggccgcguucaaguggcgacagauaccaauaaugacuucgaugccaaccagaauacaaaauuuacgcccgucggggugauccaggacggaggcaccacacacagaaacgaaccccaacaguggguucucccuagcuacucuggccggaaugcucacaacgugcaucuggccccggccgucgcucccaccuucccuggggagcagcuucuguuuuuccgcuccacaaugcccggauguagcggcuauccuaauauggaucucgacugccugcugccccaggaaugggugcaacacuuuuaccaggaggccgcgccugcucagucugauguggcccuccugagauucguuaaccccgacaccgggcggguccuuuuugaguguaagcugcauaaaagcggauaugugacgguggcccacaccggccagcacgaucucgucauuccgccuaacggguacuucagauuugacuccugggugaaucaauucuauacacuggcucccaugggcaacggaaccggccgccggagagcccuuuga

SEQ ID NO: 27786 - RNA, 1623 nt, Artificial Sequence
  derived and/or modified sequence opt5 from VP1__Norovirus__BAS30335
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucucacaacuacaccaugaaucucgcuucccagaacuggaauagcuaugaucccaccgaggaaauuccugcgccccugggcacaccggacuucguggggaaaauccagggaguccuuacgcagaccacaagaaccgacggcuccacacgggggcauaaggccaccguguacacgggaucugcugaguuuagcccuaagcugggccgcguucaauucgccacagauaccaacaaugacuuugaugccaaccagaauaccaaauucacacccgugggggucauucaggacggaggcaccacacacagaaacgaaccccaacagugggugcucccuuccuacagcggccggaauacgcacaacguucaucuggcuccggccguggcgcccaccuuuccuggggagcagcuucuguucuuucgcucuacaaugcccggauguuccggcuauccuaauauggaucucgacugccugcugccccaggaauggguccaauacuucuaucaggaggcugccccugcccagagcgauguggcucuccugagauuugugaaccccgacaccgggcggguucuuuucgaguguaagcugcacaaaucuggauacgucacaguggcccauaccggccagcacgaucucgugaucccgccuaacggguauuuuagauucgacagcugggucaaucaauucuacacgcuggcucccaugggcaacggaaccggccgccggagagcccuuuga

SEQ ID NO: 27787 - RNA, 1623 nt, Artificial Sequence; identical to SEQ ID NO: 27022
  derived and/or modified sequence opt5 from VP1__Norovirus__BAS30338

SEQ ID NO: 27788 - RNA, 1623 nt, Artificial Sequence; identical to SEQ ID NO: 26522
  derived and/or modified sequence opt5 from VP1__Norovirus__BAS30341

SEQ ID NO: 27789 - RNA, 1623 nt, Artificial Sequence
  derived and/or modified sequence opt5 from VP1__Norovirus__BAS30344
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaauuaauuucguucaggcucccggcggggaauuuacaguguccccucggaacgcccccggagagauccuguggucugcgccucuuggcccggaucugaaucccuaccucagccaccuggcccgcauguauaacggguacgcuggaggcuucgaaguccaggugauucuugccggcaaugcuuuuacggccgggaaaaucaucuucgcggccguuccucccaacuuuccuaccgagggacugucccccucucaggugacaauguucccgcauauuaucgucgacgugagacaacucgagccugugcugauuccccugccugauguccggaauaacuuuuaucacuacaaucagagcaacgaccccaccaucaagcucauugcuaugcuguauacaccccuucgcgccaauaacgcuggcgaugacguuuucaccguguccugcagagugcugacacggccuagcccggauuuugacuucaucuuucucgugcccccuaccgucgaaucucgcacgaaacccuucuccguuccugugcugaccgucgaggaaaugacaaacagcagauuucccauuccgcuugagaagcuguucaccgggccuucuuccgccuucgugguucagccccagaauggacgguguacaaccgauggcgugcuccuggggacgacacaacugagcccugucaacaucugcaccuuucgcggagacgugacacauauccccggcucuagaaauuacaccaugaaccucgccucccagaauuggaacagcuaugauccuaccgaggaaauucccgcuccgcugggcacaccugacuucgucgggaaaauccagggagugcuuacgcagaccacacggaccaauggcuccacacgcgggcacaaggcgaccguuuacacgggaucugccgacuuuagccccaagcugggcagagugcaauucgcuacagauaccgacaacgauuuugagaccaaucagaacacaaaauucacccccgucggggugauucaggacggauccacaacgccucggaaugaaccgcaacaguggguucuccccagcuacucuggccgcaacauccauaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcacaaaagcggguacgugacaguggcccauaccggacagcacgaucucgucauucccccuaacggcuauuuucgcuucgacuccugggugaaccaauucuacacgcuggcucccauggggaauggcaccggacggagacgcgcccuuuga

SEQ ID NO: 27790 - RNA, 1623 nt, Artificial Sequence; identical to SEQ ID NO: 26522
  derived and/or modified sequence opt5 from VP1__Norovirus__BAS30347

SEQ ID NO: 27791 - RNA, 1623 nt, Artificial Sequence; identical to SEQ ID NO: 26522
  derived and/or modified sequence opt5 from VP1__Norovirus__BAS30350

SEQ ID NO: 27792 - RNA, 1623 nt, Artificial Sequence
  derived and/or modified sequence opt5 from VP1__Norovirus__BAS30353
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagcucaaugaccccaccauuaagcugaucgcuaugcuuuauacaccccugcgcgccaacaacgcuggcgaugacguuuucaccgugagcugcagagugcucacacggccuuccccggauuuugacuucauuuuucuggugcccccuaccgucgaaagccgcacgaaacccuucucuguuccugugcuuaccgucgaggaaaugacaaauuccagauuucccaucccgcuggagaagcuguucaccgggccuagcucugccuucgugguucagccccagaacggacgguguacaaccgauggcgugcugcuggggacgacacaacucuccccugucaauauuugcaccuuucgcggagacgugacacauauccccggcagcagaaacuacaccaugaaucuggccucucagaacuggaacuccuaugauccuaccgaggaaauccccgcuccgcuuggcacaccugacuucgucgggaaaauucagggagugcugacgcagaccacacggaccaauggcagcacacgcgggcacaaggcgaccguuuacacgggauccgccgacuuuucucccaagcucggcagagugcaauucgcuacagauaccgacaaugauuuugagaccaaccagaauacaaaauucacccccgucggggugauccaggacggaagcacaacgccucggaacgaaccgcaacaguggguucugcccuccuacagcggccgcaauauucauaacgugcaccuugccccugccgucgcucccaccuuuccuggcgagcagcuccucuucuuuagaucuacaaugcccggguguuccggauauccuaauauggaucuggacugccugcucccccaggaaugggugcaauacuucuaucaggaggccgcgccggcucagagcgauguggcccugcuucgguuuguuaacccugacaccggcagaguccuguucgaguguaagcuccacaaaucuggguacgugacaguggcccauaccggacagcacgaucuggucauucccccuaacggcuauuuucgcuucgacagcugggugaaucaauucuacacgcuugcucccauggggaacggcaccggacggagacgcgcccuguga

SEQ ID NO: 27793 - RNA, 1623 nt, Artificial Sequence
  derived and/or modified sequence opt5 from VP1__Norovirus__BAS30356
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugaaccucuuggcccggaucugaaccccuaccucagccaccuggcgcgcauguauaauggguacgccggaggcuucgagguccaggugauccuugcuggcaacgccuuuacggcugggaaaauuaucuucgccgcgguuccucccaauuuuccuaccgagggacugucccccucucaggugacaauguucccgcauaucauugucgacgugagacaacucgaaccugugcugaucccccugccugauguccggaacaauuuuuaucacuacaaccagagcaaugacuccaccauuaagcucaucgccaugcuguauacaccccuucgcgcuaacaacgccggcgaugacguuuucaccgugagcugcagagugcugacacggcccucuccugauuuugacuucauuuuucucgucccgcccaccguggagucccgcacgaaaccuuucagcguucccgugcugaccgucgaagagaugacaaauucuagauuuccuaucccccuugagaagcuguucaccgggccguccagcgcuuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaagagaucccugcuccccugggcacaccggacuucgucgggaaaauucagggagugcuuacgcagaccacacggaccaauggcucuacacgcgggcacaaggccaccguuuacacgggaagcgcggacuuuuccccuaagcugggcagagugcaauucgccacagauaccgacaaugauuuugaaaccaaccagaauacaaaauucacccccgucggggugauccaggacggaggcacaacgcaucggaacgagccccaacaguggguucucccuagcuacucuggccgcaauauucacaacgugcaccuggcuccggccgucgcccccaccuuuccuggggaacagcuucuguucuuuagauccacaaugcccggauguagcggcuauccuaauauggaucucgacugccugcugccccaggagugggugcaauacuucuaucaggaggcugccccugcgcagucugauguggcucuccugcgguuuguuaaccccgacaccgggagaguccuuuucgaauguaagcugcauaaaagcggauacgugacaguggcccacaccggccagcaugaucucgucaucccgccuaacggguauuuucgcuucgacuccugggugaaucaauucuacacgcuggcccccaugggcaacggaaccggccggagacgcgcucuuuga

SEQ ID NO: 27794 - RNA, 1623 nt, Artificial Sequence; identical to SEQ ID NO: 27045
  derived and/or modified sequence opt5 from VP1__Norovirus__BAS30359

SEQ ID NO: 27795 - RNA, 1623 nt, Artificial Sequence; identical to SEQ ID NO: 26522
  derived and/or modified sequence opt5 from VP1__Norovirus__BAS30362

SEQ ID NO: 27796 - RNA, 1623 nt, Artificial Sequence; identical to SEQ ID NO: 26518
  derived and/or modified sequence opt5 from VP1__Norovirus__BAS30365

SEQ ID NO: 27797 - RNA, 1623 nt, Artificial Sequence; identical to SEQ ID NO: 26522
  derived and/or modified sequence opt5 from VP1__Norovirus__BAS30368

SEQ ID NO: 27798 - RNA, 1623 nt, Artificial Sequence; identical to SEQ ID NO: 26522
  derived and/or modified sequence opt5 from VP1__Norovirus__BAS30371

SEQ ID NO: 27799 - RNA, 1623 nt, Artificial Sequence
  derived and/or modified sequence opt5 from VP1__Norovirus__BAS30374
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccucccagaacuggaauagcuaugaucccacagaggaaaucccugcuccccugggcacgccggacuucgucgggaaaauucagggagugcuuacccagacaacccggacaaacggcuccacccgcgggcacaaggcgacgguuuacacaggaucugccgacuuuagcccuaagcugggcagagugcaauucgcuaccgauaccgacaaugauuuugaggccaaccagaauacaaaauucacccccgucggggugauccaggacggauccacaacgccccggaacgaaccucaacaguggguucucccgagcuacucuggccgcaauauucauaacgugcaccuggcccccgcugucgccccuaccuuucccggcgagcagcuucuguucuuuagauccacaaugccuggguguagcggauaucccaauauggaucucgacugccugcugccucaggaaugggugcaauacuucuaucaggaggcggcucccgcccagucugauguggcccuccugcgguuuguuaacccggacaccggcagaguccuuuucgaguguaagcugcacaaaagcggguacgugacaguggcucauaccggacagcacgaucucgucaucccucccaacggcuauuuucgcuucgacuccugggugaaucaauucuacacgcuggccccuauggggaacggcaccggacggagacgcgcucuuuga

SEQ ID NO: 27800 - RNA, 1623 nt, Artificial Sequence
  derived and/or modified sequence opt5 from VP1__Norovirus__BAU16297
augaagauggccagcaacgacgauaaucccuccgacggcucugcugccaaccuggugccugaggucaauaacgaaguuauggcgcucgagccgguggugggggcugccaucgccgcucccgucgccggacagcaaaaugugauugauccuuggaucagaaacaauuucguucaggcucccggcggggaauuuaccgugagcccucggaacgcccccggagagauucugugguccgcgccucuuggcccggaccugaaucccuaccucucucaccuggcccgcauguauaacggguacgcuggaggcuucgaaguccaggugauccuugccggcaaugcuuuuacagccgggaaaguuauuuucgcggccgugccucccaacuuuccuacggagggacugagccccucccaggucaccauguucccgcauaucgugguggaugucagacaacucgagccuguucugaucccccugccugacgugcggaauaacuuuuaucacuacaaucagucuaacgaucccacaauuaagcucaucgcuaugcuguauacaccccuucgcgccaacaaugcuggcgacgauguguucaccgucagcugcagagugcugacccggccuuccccggacuuugauuucauuuuucucguucccccuacaguggaaagccgcaccaaacccuucucugucccugugcugacgguugaggaaaugaccaacuccagauuucccaucccgcuugagaagcuguucacagggccuagcucugccuucgugguccagccccagaauggacgguguaccacagacggcgugcuccuggggaccacgcaacuguccccugucaacauuugcacauuucgcggagaugugacccauaucacaggcagcagaaauuacaccaugaaccucgccucucagaauuggaacaauuaugaccccaccgaggaaauuccugcuccccugggcacaccggacuucguugggaaaauccagggagugcuuacgcagaccacacggaccgauggcuccacacgcgggcacaaggcgaccgucuacacgggaagcgccgacuuugcuccuaagcugggcagagugcaauucgagacagauaccgaccaugauuuugaagccaaccagaauaccaaauucacacccguuggggugauccaggacggaggcaccacacaccggaacgagccccaacaguggguccucccuuccuacucuggccgcgauacgcacaaugugcaucuggccccggcuguggcccccaccuuuccuggggaacagcuucuguucuuuagaagcacaaugcccggauguuccggcuauccuaacauggaccucgauugccugcugccccaggaguggguucaauacuucuaucaggaggcggcuccugcccagagcgacgucgcccuccugcgguuugugaaucccgauaccgggagagugcuuuucgaauguaagcugcacaaaucuggauacgucacaguggcucauaccggccagcacgaccucguuauuccgccuaacggguauuuucgcuucgacuccugggugaacaaguucuacacgcuggcccccaugggcaauggaaccggccggagacgcgcugucuga

SEQ ID NO: 27801 - RNA, 1623 nt, Artificial Sequence
  derived and/or modified sequence opt5 from VP1__Norovirus__BAU16299
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaaucaacuucgugcaagccccuaauggagaauuuacggugucuccccggaacagcccuggcgagauucuucugaaucucgaacuggggccggaucuuaaccccuaccuggcgcaccucucccgcgucuauaauggauacgccggcggcguggagguucaggugcugcuggcugggaacgccuucaccgcuggaaaaauccucuuugccgcggucccucccaauuucccuguggaguuucugucucccgcccagaucacaaugcuuccgcaucugauuguugacgugagaacccucgaaccuaucaugauuccccugccugauguccggaacacauucuuucacuauagcaaucagcccaacucccgcaugagacuuguggcuaugcuguacacaccccuccggucuaacggcagcggggacgauguguucaccgucuccugccgcguucugaccagaccuacgccggacuuugaguucaccuaucuggugcccccuagcguggaaucuaagacaaaacccuuuucccucccuauccugacccuuagcgagcugacaaauucucgguuccccgucccgauugauucccucuuuaccgcccaugacaacguguggcaaguucagugucagaauggacgcugcacgcuggauggcgagcuucaggggacaacccaacugcucccuacaggaaucugugcuuucagaggccgggugaccgcccagauuaaccagcgcgacagauggcacaugcagcugcaaaaucugaacggcaccacauacgaucccacggacgacgucccugcuccccucgggaccccugauuucaagggagugguuuuuggcauggugagccagcggaaugucgggaacgacgcccccggaucuacacgcgcgcagcaagccuggguguccaccuauagcccgcaguucgucccuaaacugggcuccgugaaucuuagaaucucugauaacgacgauuuucaguuccagcccacaaaguuuacccccguuggggugaaugacgaugacgauggacauccuuuccggcaaugggaacugccgaacuacagcggcgagcucacgcugaauaugaaccuugcucccccugucgcccccaauuuuccuggcgaacagcuccuguucuuuagauccuucgugcccugcagcgggggauacaaccagggcaucauugacugucugaucccucaggaguggauucaacacuuuuaucaggaaucugcccccucccagagcgauguugcucugauccgcuacgugaacccggacacagggcggacccucuucgaggccaagcugcacagaucuggauauauuaccgucgcgcauagcggcgacuacccucuuguggugcccgcuaaugggcacuuucgcuucgauuccuggguuaaccaguucuauucucuggccccuauggagacaggcaauggacggagacgcgcccaauga

SEQ ID NO: 27802 - RNA, 1635 nt, Artificial Sequence
  derived and/or modified sequence opt5 from VP1__Norovirus__BAU16301
augaugauggccagcaaggacgcugcccccuccgcggauggcgcuaccggggccggacagcuggugccugaggucaacacagccgacccgauccccauugauccuguugcuggcucuagcacggcccucgcuaccgccgggcaagugaaucugaucgaccccuggauuaucaacaauuucgugcaggcgccucagggagaauuuacaauuucccccaacaauaccccuggcgauguccuuuucgaccugcagcucgggccgcaccugaaccccuuucuuucucaucugagccaaauguacaauggaugggugggcaacaugagaguucgggugguccucgccggcaaugcuuucacagccgggaaagugaucaucugcuguguuccucccggauuucagucccgcacccugucuauugcucaggccacacuguucccucacgugaucgcggaugucagaacccucgaccccguggaggugccgcuggaagauguccggaacguucuuuaucauaauaacgacacgcagccuaccaugcgccugcucugcaugcuguacacaccccuuagaaccggcggggccagcggaggcacagauuccuuugugguggcugggcggguccugaccuguccuggacccgacuucaauuuucucuuccuggugcccccuacgguugagcaaaagacacgcccguuuaccgugcccaacauuccucugaaauaucucagcaauucuagaauccccaacccuauugaaggcaugucccugagccccgaucagacacagaacguccaguuccaaaauggccggugcaccaucgacgggcagccgcuuggaaccacaccugugucuguuucccagcuguguaaguuucgcggcagaauuacgagcgggcaaaaagugcucaaccugaccgagcuugacggaucucccuucauggccuucgcugccccugcccccgucggcuuuccugaucugggguccugcgacuggcacaucgagaugagcaagauccccaauuccucuacacagagcaacccgauuguggucaauuccgugaagccuaacagccagcaguucguuccccaucucucuuccaucacccuggaugacaaugugagcucuggaggcgauuacauuggcacaauccaauggaccagcccucccuccgggucuggaggcgcuaacacgaauuuuuggaaaauuccggacuaugggagcucccuggcggaagccagccagcucgcucccgccgucuacccucccggauucaacgaggugaucguuuauuuuauggccucuaucccuggccccaaucaguccgggagcccuaaccuggugcccugucuucugccgcaggaauacauuacacacuucaucucugagcaagcuccuauucagggcgaggccgcgcuccugcacuacgucgaucccgacaccaaucggaaccuuggagaauuuaagcuguauccuggcggguaccugaccugcgugcccaauuccagcuccacaggaccgcagcagcucccucuggauggcguguucguuuuugcuucuugggucagccgcuucuaucaacucaaacccguggggaccgccggaccugccagaggccggcugggggugcgcagauga

SEQ ID NO: 27803 - RNA, 1623 nt, Artificial Sequence
  derived and/or modified sequence opt5 from VP1__Norovirus__BAU16303
augaugauggccagcaaggacgugcccaccuccccugauggcgcuucuggggccggacagcuggucccggagguuaacacagcggaccaaaucagcauggaucccguggcuggcgccuccacggccguggcuaccgccgggcaggucaauaugauugacccuuggaucuucaacaauuuugugcaggcuccccagggagaguucacaauuucuccuaacaauacccccggcgauauccucuuugaccugcaacuugggccucaccugaacccguuccucgcccaucugagccagauguacaauggauggguuggcaacaugagagugcggauucuucuggcgggcaaugccuuuacagcugggaaaaucaucauuugcugugugcccccuggauucgaugcccgcauccucaccauugcucaggccacacuguuuccccaccugaucgcggacgucagaacccucgaaccuguugaacugccccuugaggaugugcggaacguccuguaucauaauuccucucagccgcaaccuacgaugcgccucguggccaugcuguacacaccccuuagaaccggcgggggaagcggcgggaccgacgcuuucguggucgccggacggguucugacaugcccugcucccgauuuuuccuuccucuuucuggugcccccuagcguggaacagaagacccgcgucuucucugugccgaacauuccccugaaagaccucuccaauagcagaguuccuacgcugauccagggcauguuugugucucccgaugucaaccaguccgugcaauuccagaauggccggugucagauugacgggcaacuucagggaacaaccccuguuagccugucucagcucugcaagauccgcggcaaaacauccagcaacaccagagugcugaaccuuuccgaggucgacgggacccccuucgugccgcuggagucuccugcccccgucggauuuccugauaucggcgggugugacuggcacgugggauucacauuugaagcccgggaucagggccccagccaaaauguuacguucgcuaccaacgacuccagcuuugugccuuaucucggcucuauuagcccccauaauggggauggauuccacuccggcgacaucauugggucucuggauuggaucagcgcgccguccgacggaucugcccuggaugucuggagcauuccuaaguacggcuccagccuccccgacgugacacaccuggcucccgccguuuuuccuccgggguucggcgaggugauccuuuauuuucauucuaaguuccccggauccggcccuaccgauaaacugcgcguccccugccucaugccucaggaauuuaucacacacuucugugacgagcaggcccccauugcuggggaggccgcgcugcuucauuacguggacccugaugcuggaagaaaccugggcgaauuuaagcucuaucccgacggguucaugaccugcgugccgaauagcaucucuuccggaccucagacgcugcccauuaacggcguuuucgucuuugugagcugggugucccgguucuaccaacugaaaccugucgggacagccucuauggcccgcagacucggccugcggagaaucuga

SEQ ID NO: 27804 - RNA, 1647 nt, Artificial Sequence
  derived and/or modified sequence opt5 from VP1__Norovirus__BAU16305
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuuuccacagacaaucugucugccgcucagaucaccaugugcccccaugugauugucgaugugcgccaacuggagccuguuaaccuccccaugccggacgugagaaauaacuucuuucacuauaaccagggcagcgauucccggcugcgccuuaucgccaugcuguacacaccucucagagccaauaacucuggggacgaugucuucaccgugagcugucgggugcugacacgccccuccccugacuuuagcuucaauuuucuugucccucccaccguugaaucuaagacgaaacccuucacccugccgauucucacaaucuccgagaugagcaacucuagauuucccgugccuauugauucccugcauaccagccccacagaaaauguggucgugcagugccagaacggacggguuacccuggacggcgagcucauggggacgacacaacugcuuccuucucagaucugugcuuuccgcggagugcugaccagauccacaagccgggcguccgaucaggccgacaccgcugcuccccgccucuucaauuauuacuggcacauccagcuggacaaccuuaauggcaccccguaugauccugccgaggacauucccggcccucuggggacacccgauuuuagaggaaaggucuucggcguggccucucaacggaacccugacagcacgacccgcgcccaugaagcgaaaguugauacaaccgcugggagauuuacacccaagcucggaucccuggagaucagcaccgaaucugacgauuucgaccagaaucagccgacgcgguuuacaccugugggcauuggggucgaucacgaggccgacuuccaacaguggucccugcccgauuacagcggacaguuuacccacaacaugaaucucgcccccgcuguggccccuaacuucccgggcgaacagcugcuguuuuucagaucucaacuucccagcuccggcgggcgcucuaauggaauccucgacugccuggucccucaggagugggugcagcauuuuuaccaggagagcgcucccgcccaaacccagguugcgcuugugcgguaugucaacccugacacaggcagagugcuguucgaagccaagcuccacaaacugggguuuaugaccauugcuaagaacggagauucccccaucaucguuccucccgacggcuacuuccgcuucgagagcugggugaauccguuuuauacacuggccccuauggggauuggcaacggacggagacgcauccaguga

SEQ ID NO: 27805 - RNA, 1671 nt, Artificial Sequence
  derived and/or modified sequence opt5 from VP1__Norovirus__BAU16306
augaagauggccagcuccgacgcugcccccucugcggauggcgcugggaaccuggugccugagagccagcaagaaguccucccgcuggcccccguugccggagcugcccuugcugccccuguggugggccagaccaauaucauugaccccuggaucaaggagaacuucguccaggcgccucagggggaauuuacagugucccccaagaacucuccuggagagauucugguuaaucucgaacugggcccgaaacuuaaucccuaccuggaucaccucagcagaauguauaacuccuacgccgggggaaucgacgugauggucgugcuggcuggcaaugccuucacggcuggcaagguucugauugccgcgaucccucccaacuuuccuguggagggggucucugccagccaagcuacccaguucccccaugugaucauugaugugcggacacucgacccgguccgccugccucuucccgauguuagauccaccuuuuuccacuauacaaaugacaccgagccuaaaaugcggcuggugaucuggcucuacacaccccugcgcaccaacggaagcggcgaugacucuuuuacgguguccgggcggauucuuaccagacccagccaggauuucgaauuugccuuccugaucccuccgacagucgagaccaagacaacccccuuuucugugccuggauucuccguucaggaaaugagcaauucucgcuggcccgcugccauuuccgccaugguggucagaggcaacgagccucaagugguucaguuucagaaugggcgggcucaucucgacggaaugcugcugggcacgacacccgugagcccgaacuauaucgcguccuaccgcggcauuucuaccgggaauagcagauccgccagcccugaggcugaugaacgggccgucggaucuuucgacguguggauccgccuccaggagcccgacggccaaccuuaugauaucuucgggaagcagcccgccccuauuggaacacccgacuuuaaagcugucaucgugggcuucgccgcgagaccgcugaccuccgggagcuacgcuaacgaagccuacguuaacaccacagccucugauuaugcuccugccacgggaaauaugcgguuuaccgugcgcaacggcggcagcgggcacauuuccgcuaauaaguacugggaguucaaaucuuuuggagucgaaggcgagagacauacagacauccaguaucaagaguacgaacuucccgauuauagcggacagguggccuccaaccacaaucuggcgcccccuguugccccgcggaugcccggggagagccuccugcuuuuccagucuaacaugccugugugggacgauggccacggggaauccacccccaagaaaauucauugccugcucccucaggaguuuaucggccacuucuuugacaagcaagcucccagccugggagaugccgcucugcucagauacgucaaucaggaaacaaaccgcgugcuguucgaguguaaacuuuaucgggacggcuacaucaccguggccgcgucuuccgggcugcucgauuuuccucuggacggauucuuuagauucgacagcuggguuuccucuuucuacauucuuagccccgucggcuccgggcagggacgccggggcagagugcgcuuucaguga

SEQ ID NO: 27806 - RNA, 1626 nt, Artificial Sequence
  derived and/or modified sequence opt5 from VP1__Norovirus__BAU16307
augaugauggccagcaaggacgcuacccccuccgccgauggcgcgaacggggcuggacagcuggugccugaggucaauaacgccgaaccgcucccccuggacccuguugccggcgcuucuacagcccuugcuacggccgggcaagugaauaugaucgaucccuggauuuucaacaauuuugugcaggcgccucagggagaguucaccaucagccccaacaauacaccuggcgacauucuguuugaucuccagcuggggccgcaccuuaaccccuuccuggcccaucucucccaaauguacaauggaugggucggcaacaugagagugcggguuauccuggcuggcaaugccuuuaccgcugggaaagugauuaucugcugugucccucccggauuccagucucgcacacugagcaucgcccaggcgacccucuuuccucacgugauugccgacguuagaacacuggaaccccuugagaucccgcuggaagaugugcggaacacccucuaucauaauaacgacucccagccuacgaugcgccugcuuugcaugcuguacacaccccucagaaccggcgggggaucuggcgggaccgaugcuuucgucguggccggacgggugcugacauguccuagccccgacuuuaauuuccuguuucucguucccccuaccgucgagcaaaagacgcgcccguucuccgugcccaacauuccucugcagaaccuuagcaauucuagagugcccucccugauccagagcaugguccucucuuccgaucacgcucagacagugcaauuucagaacggccggugcaccacagacggccaucugcuugggaccaccccuguuagcucuggacagcugaugaaauuccgcggcaaggugacacccggguccaaaguccucaaucugacggagcuggauggaagcccguuccucgccuuugaaccucccgccccugcuggcuuccccgaccuggggaagugugacuggcacauugagaugucccuuuaucaagugaacaaucaggauaacccuaucguucugagagcgauugaacccaauucuagcuccuuugugccgcaccucggaagcgucucuuucaaccagaauguggacgccgcuggcgauuacgucugcaccauccaguauacauccccucccagcaacucucaugacgccgauguggacuuuuggagcauccccgauuacggcuccaaucuggccgaggcuucucaacuugccccuguuguguauccgcccggguucggagaggcgauugucuacuuuaugagccgggugccuggcuggaaccgcaccaauagacugaaccucguucccugucugcugccucaggaguucaucgggcacuuuguguccgaacaggcucccgccauuggagaagccgcucuccugcauuacgucgacccugauacaaaucggaaccuuggcgaguucaagcuguaucccgaaggguuuauuaccugcgugccgaacggcacgggaccucagcaacucccccugaauggcguguucguuuuuagcucuugggucucccgcuucuaccagcugaaaccuguggggacagccagcucugcuagaggacggcuuggcaucagacgcuga

SEQ ID NO: 27807 - RNA, 1623 nt, Artificial Sequence; identical to SEQ ID NO: 27133
  derived and/or modified sequence opt5 from VP1__Norovirus__BAU24831

SEQ ID NO: 27808 - RNA, 1623 nt, Artificial Sequence; identical to SEQ ID NO: 27085
  derived and/or modified sequence opt5 from VP1__Norovirus__BAU24834

SEQ ID NO: 27809 - RNA, 1623 nt, Artificial Sequence
  derived and/or modified sequence opt5 from VP1__Norovirus__BAU24837
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacugguccaauuaugauccuaccgaggaaauucccgcgccucugggcacacccgacuucguugggaaaauccagggagugcuuacgcagaccacacggaccgacggcucuacacgcgggcacaaggccaccgucuacacgggaagcgcugauuuugugccgaagcugggcagaguucaauucgagacagacaccgaucgggacuuugaagccaaccagaauaccaaauucacaccugugggggucauccaggauggauccaccacacaucgcaacgagccccaacagugggugcuccccagcuacucuggcagaaauacgccuaacgugcaccuggccccggcuguugcccccaccuuuccuggcgaacagcuucuguucuuucgguccacaaugcccggguguagcggauauccuaauauggaccucgauugccugcugccccaggaguggguccaauacuucuaucaggaggcggcuccugcccagucugacguggcccuccugagauuugugaaccccgauaccggccgcguccuuuucgaauguaagcugcacaaaagcggguacgugacaguugcucauaccggacagcacgaccucgugauuccgccuaauggcuauuuucgguucgauuccugggucaaccaauucuacacgcuggcccccauggggaacggcaccggaagacgccgggcucuuuga

SEQ ID NO: 27810 - RNA, 1623 nt, Artificial Sequence
  derived and/or modified sequence opt5 from VP1__Norovirus__BAU24840
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacacuccgcggagacgugacccauaucacaggcucuagaaacuacaccaugaaucuggcuucccagaacuggagcaauuaugaucccaccgaggaaauuccugcgccccuuggcacaccggacuuuguugggaaaauccagggagugcugacgcagaccacacggaccgacggcuccacacgcgggcacaaggccaccgucuacacgggaucugcugauuucgccccuaagcucggcagagugcaauuugagacagacaccgaucgggacuucgaagccaaccagaauaccaaauuuacacccguuggggugauccaggauggaagcaccacacaucgcaacgagccccaacaguggguccugccuuccuacagcggcagaaauacgccgaacgugcaccuugcucccgccguggcgccuaccuuccccggcgaacagcugcucuuuuuccggucuacaaugccuggguguuccggauaucccaauauggaccuggauugccugcucccucaggaguggguucaauacuuuuaucaggaggcugcccccgcccagagcgacgucgcucugcuuagauucgugaacccggauaccggccgcgugcuguuugaauguaagcuccacaaaucuggguacgucacaguggcccauaccggacagcacgaccugguuauuccucccaauggcuauuuccgguuugauagcugggugaaccaauucuacacgcuugcuccuauggggaacggcaccggaagacgccgggcccuguga

SEQ ID NO: 27811 - RNA, 1623 nt, Artificial Sequence; identical to SEQ ID NO: 27085
  derived and/or modified sequence opt5 from VP1__Norovirus__BAU24843

SEQ ID NO: 27812 - RNA, 1623 nt, Artificial Sequence
  derived and/or modified sequence opt5 from VP1__Norovirus__BAU24846
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgaaacagacaccgagaacgauuuugaaacccaucaaaauacaaaguucacccccguuggagugauucaggacggcggcacaacgcaccgcaacgagccccagcaauggguccugccuucuuacagcgggagaaaugugccgaacguucaccuugcccccgcuguggccccuaccuuucccggagagcagcuccuguucuuucgguccaucaugccuggcuguagcggguaucccaauauggaucuggacugccugcucccucaggaauggguccagcauuucuaccaagaggcggcucccgcccagucugauguggcccugcuucgcuuugugaacccggacacaggaagaguucuguucgaauguaaacuccacaaguccggcuaugucaccguggcucauacagggcagcacgaucuggugauuccucccaacggcuacuuucgguucgacagcugggucaaucaguucuauacccuugccccuaugggaaacggcacggggagacgccgggcucuguga

SEQ ID NO: 27813 - RNA, 1623 nt, Artificial Sequence; identical to SEQ ID NO: 27085
  derived and/or modified sequence opt5 from VP1__Norovirus__BAU24849

SEQ ID NO: 27814 - RNA, 1623 nt, Artificial Sequence
  derived and/or modified sequence opt5 from VP1__Norovirus__BAU24852
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucgggacuuugaagccaaucagaacaccaaauucacacccguuggggugauccaggauggaucuaccacacaucgcaaugagccccaacaguggguccucccuagcuacuccggcagaaacacgcacaaugugcaccuggcuccggccguggcgcccaccuuuccuggcgaacagcuucuguucuuucggagcacaaugcccggguguucuggauauccuaacauggaccucgauugccugcugccccaggaguggguucaauacuucuaucaggaggcugccccugcccaguccgacgucgcucuccugagauuugugaaucccgauaccggccgcgugcuuuucgaauguaagcugcauaaaagcggguacgucacaguggcccacaccggacagcaugaccucguuauuccgccuaacggcuauuuucgguucgauucuugggugaaccaauucuacacgcuggcucccauggggaauggcaccggaagacgccgggccgucuga

SEQ ID NO: 27815 - RNA, 1623 nt, Artificial Sequence; identical to SEQ ID NO: 27812
  derived and/or modified sequence opt5 from VP1__Norovirus__BAU24855

SEQ ID NO: 27816 - RNA, 1623 nt, Artificial Sequence; identical to SEQ ID NO: 27133
  derived and/or modified sequence opt5 from VP1__Norovirus__BAU24858

SEQ ID NO: 27817 - RNA, 1623 nt, Artificial Sequence
  derived and/or modified sequence opt5 from VP1__Norovirus__BAU24861
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgaaacagacaccgagaacgauuuugaaacccaucaaaauacaaaguucacccccguuggagugauucaggacggcggcacaacgcaccgcaacgagccccagcaauggguccugccuucuuacagcgggagaaaugugccgaacguucaccuugcccccgcuguggccccuaccuuucccggagagcagcuccuguucuuucgguccacaaugccuggcuguagcggguaucccaauauggaucuggacugccugcucccucaggaauggguccagcauuucuaccaagaggcggcucccgcccagucugauguggcccugcuucgcuuugugaacccggacaccggaagaguucuguucgaauguaaacuccacaaguccggcuaugucacaguggcucauaccgggcagcacgaucuggugaucccucccaacggcuacuuucgguucgacagcugggucaaucaguucuauacgcuugccccuaugggaaacggcaccgggagacgccgggcucuguga

SEQ ID NO: 27818 - RNA, 1623 nt, Artificial Sequence; identical to SEQ ID NO: 27085
  derived and/or modified sequence opt5 from VP1__Norovirus__BAU24864

SEQ ID NO: 27819 - RNA, 1623 nt, Artificial Sequence
  derived and/or modified sequence opt5 from VP1__Norovirus__BAU24867
augaagauggccagcuccgacgcuaaccccaccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaguuauuuucgccgcugugccucccaauuuuccuaccgagggacugagccccucccaggucacaauguucccgcauaucgugguggacgucagacaacucgagccuguucugaucccccugccugaugugcggaacaauuuuuaucacuacaaccagucuaaugaccccaccauuaagcucaucgccaugcuguauacaccccuucgcgcuaacaacgccggcgaugacguguucaccgucagcugcagagugcugacacggccuuccccggauuuugacuucauuuuucucguucccccuaccguggaaagccgcacgaaacccuucucugucccugugcugaccguugaggaaaugacaaauuccagauuucccaucccgcuugagaagcuguucaccgggccuagcucugccuucgugguccagccccagaacggacgguguacaaccgauggcgugcuccuggggacgacacaacuguccccugucaauauuugcaccuuucgcggagacgugacacauaucaccggcagcagaaacuacaccaugaaucucgcuucucagaacugguccaauuaugaucccacagaggaaauuccugcgccccugggcacgccggacuucguugggaaaauccagggagugcuuacccagacaacccggacagacggcagcacccgcgggcacaaggccacggucuacacaggauccgcugauuuugccccuaagcugggcagagugcaauucgagaccgacaccgaucaugacuuugaagccaaccagaauacaaaauucacccccguuggggugauccaggauggaucuacaacgcaccggaacgagccccaacaguggguccucccuagcuacuccggccgcaauaccccgaacgugcaccuggcucccgccguggcgccuacauuucccggcgaacagcuucuguucuuuagaagcaccaugccuggguguucuggauaucccaauauggaccucgauugccugcugccucaggaguggguucaauacuucuaucaggaggcugcccccgcccaguccgacgucgcucuccugcgguuugugaacccggauacaggcagagugcuuuucgaauguaagcugcauaaaagcggguacgucaccguggcccacacgggacagcaugaccucguuauuccucccaauggcuauuuucgcuucgauucuugggugaaccaauucuacacccuggcuccuauggggaacggcacaggacggagacgcgcccuuuga

SEQ ID NO: 27820 - RNA, 1623 nt, Artificial Sequence; identical to SEQ ID NO: 27133
  derived and/or modified sequence opt5 from VP1__Norovirus__BAU24870

SEQ ID NO: 27821 - RNA, 1623 nt, Artificial Sequence; identical to SEQ ID NO: 27085
  derived and/or modified sequence opt5 from VP1__Norovirus__BAU24873

SEQ ID NO: 27822 - RNA, 1623 nt, Artificial Sequence; identical to SEQ ID NO: 27085
  derived and/or modified sequence opt5 from VP1__Norovirus__BAU24876

SEQ ID NO: 27823 - RNA, 1623 nt, Artificial Sequence; identical to SEQ ID NO: 27085
  derived and/or modified sequence opt5 from VP1__Norovirus__BAU24879

SEQ ID NO: 27824 - RNA, 1623 nt, Artificial Sequence
  derived and/or modified sequence opt5 from VP1__Norovirus__BAU24882
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaaaccaaucagaacacaaaauucacccccguuggggugauccaggauggaggcacaacgcaccggaaugagccccaacaguggguccucccuucuuacagcggccgcaacaccccgaaugugcaccuggcccccgcuguggccccuacauuucccggggaacagcuucuguucuuuagauccaccaugccuggauguagcggcuaucccaacauggaccucgauugccugcugccucaggaguggguucaauacuucuaucaggaggcggcucccgcccagucugacgucgcccuccugcgguuugugaauccggauacagggagagugcuuuucgaauguaagcugcauaaauccggauacgucaccguggcucacacgggccagcaugaccucguuauuccucccaacggguauuuucgcuucgauagcugggugaaccaauucuacacccuggccccuaugggcaauggaacaggccggagacgcgcucuuuga

SEQ ID NO: 27825 - RNA, 1623 nt, Artificial Sequence
  derived and/or modified sequence opt5 from VP1__Norovirus__BAU24885
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcgacacgcacaacgugcaucuggcuccggccguggcgcccaccuuuccuggggaacagcuucuguucuuuagauccacaaugcccggauguagcggcuauccuaauauggaucucgacugccugcugccccaggaguggguucaauacuucuaucaggaggcugccccugcccagucugaugucgcucuccugcgguuugugaaccccgacaccgggagagugcuuuucgaauguaagcugcacaaauccggauacgucacaguggcccauaccggccagcacgaucucguuauuccgccuaauggguauuuucgcuucgacagcugggugaaccaauucuacacgcuggcucccaugggcaacggaaccggccggagacgcgccgucuga

SEQ ID NO: 27826 - RNA, 1623 nt, Artificial Sequence; identical to SEQ ID NO: 27085
  derived and/or modified sequence opt5 from VP1__Norovirus__BAU24888

SEQ ID NO: 27827 - RNA, 1623 nt, Artificial Sequence
  derived and/or modified sequence opt5 from VP1__Norovirus__BAU24891
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgccacagacaccgaaaacgauuuugagacccaucaaaauacaaaguucacccccguuggagugauucaggacggcggcacaacgcaccgcaacgaaccccagcaauggguccugccuucuuacagcgggagaaaugugccgaacguucaccuugcucccgccguggcgccuaccuuucccggagagcagcuccuguucuuucgguccacaaugccuggcuguagcggguaucccaauauggaucuggacugccugcucccucaggaguggguccagcauuucuaccaagaagcugcccccgcccagucugauguggcucugcuucgcuuugugaacccggacaccggaagaguucuguucgaguguaaacuccacaaguccggcuaugucacaguggcccauaccgggcagcacgaucuggugaucccucccaacggcuacuuucgguucgacagcugggucaaucaguucuauacgcuugcuccuaugggaaacggcaccgggagacgccgggcccuguga

SEQ ID NO: 27828 - RNA, 1623 nt, Artificial Sequence; identical to SEQ ID NO: 27133
  derived and/or modified sequence opt5 from VP1__Norovirus__BAU24894

SEQ ID NO: 27829 - RNA, 1623 nt, Artificial Sequence
  derived and/or modified sequence opt5 from VP1__Norovirus__BAU24897
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugugccuaagcugggcagaguucaauucgagacagacaccgaucaugacuuugaagccaaccagaauaccaaauucacacccgugggggucauccaggauggaagcaccacacaccggaacgagccccaacagugggugcucccuuccuacagcggccgcaauacgccgaacgugcaccuggcccccgcuguugccccuaccuuucccggcgaacagcuucuguucuuuagaucuacaaugccuggguguuccggauaucccaauauggaccucgauugccugcugccucaggaguggguccaauacuucuaucaggaggcggcucccgcccagagcgacguggcccuccugcgguuugugaacccggauaccggcagaguccuuuucgaauguaagcugcauaaaucuggguacgugacaguugcucacaccggacagcaugaccucgugauuccucccaauggcuauuuucgcuucgauagcugggucaaccaauucuacacgcuggccccuauggggaacggcaccggacggagacgcgcucuuuga

SEQ ID NO: 27830 - RNA, 1623 nt, Artificial Sequence; identical to SEQ ID NO: 27085
  derived and/or modified sequence opt5 from VP1__Norovirus__BAU24900

SEQ ID NO: 27831 - RNA, 1623 nt, Artificial Sequence; identical to SEQ ID NO: 27085
  derived and/or modified sequence opt5 from VP1__Norovirus__BAU24903

SEQ ID NO: 27832 - RNA, 1623 nt, Artificial Sequence; identical to SEQ ID NO: 27373
  derived and/or modified sequence opt5 from VP1__Norovirus__BAU24906

SEQ ID NO: 27833 - RNA, 1623 nt, Artificial Sequence; identical to SEQ ID NO: 27085
  derived and/or modified sequence opt5 from VP1__Norovirus__BAU24909

SEQ ID NO: 27834 - RNA, 1623 nt, Artificial Sequence; identical to SEQ ID NO: 27133
  derived and/or modified sequence opt5 from VP1__Norovirus__BAU24912

SEQ ID NO: 27835 - RNA, 1623 nt, Artificial Sequence
  derived and/or modified sequence opt5 from VP1__Norovirus__BAU24915
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagauccaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcuaauuuugccccuaagcugggcagagugcaauucgagacagauaccgaccaugauuuugaagccaaccagaauaccaaauucacacccguuggggugauccaggacggauccaccacacaccggaacgagccccaacaguggguccucccuagcuacucuggccgcaauacgccgaacgugcaccuggcucccgccguggcgccuaccuuucccggcgaacagcuucuguucuuuagauccacaaugccuggguguagcggauaucccaauauggaucucgacugccugcugccucaggaguggguucaauacuucuaucaggaggcugcccccgcccagucugaugucgcucuccugcgguuugugaacccggacaccggcagagugcuuuucgaauguaagcugcauaaaagcggguacgucacaguggcccacaccggacagcaugaucucguuauuccucccaauggcuauuuucgcuucgacuccugggugaaccaauucuacacgcuggcuccuauggggaacggcaccggacggagacgcgcccuuuga

SEQ ID NO: 27836 - RNA, 1623 nt, Artificial Sequence; identical to SEQ ID NO: 27085
  derived and/or modified sequence opt5 from VP1__Norovirus__BAU24918

SEQ ID NO: 27837 - RNA, 1623 nt, Artificial Sequence; identical to SEQ ID NO: 27085
  derived and/or modified sequence opt5 from VP1__Norovirus__BAU24921

SEQ ID NO: 27838 - RNA, 1623 nt, Artificial Sequence; identical to SEQ ID NO: 27085
  derived and/or modified sequence opt5 from VP1__Norovirus__BAU24924

SEQ ID NO: 27839 - RNA, 1623 nt, Artificial Sequence
  derived and/or modified sequence opt5 from VP1__Norovirus__BAU24927
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgccgaacgugcaccuggcucccgccguggcgccuaccuuucccggggaacagcuucuguucuuuagaagcacaaugccuggauguucuggcuaucccaauauggagcucgacugccugcugccucaggaguggguucaauacuucuaucaggaagcugcccccgcccaguccgaugucgcucuccugcgguuugugaacccggacaccgggagagugcuuuucgaguguaagcugcauaaaagcggauacgucacaguggcccacaccggccagcaugaucucguuauuccucccaauggguauuuucgcuucgacucuugggugaaccaauucuacacgcuggcuccuaugggcaacggaaccggccggagacgcgcccuuuga

SEQ ID NO: 27840 - RNA, 1623 nt, Artificial Sequence
  derived and/or modified sequence opt5 from VP1__Norovirus__BAU24930
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucaucguggacgugagacaacucgagccuguccugauuccccugccugauguucggaacaauuuuuaucacuacaaccagagcaaugacuccacaaucaagcucauugccaugcuguauacaccccuucgcgcuaacaacgccggcgaugacguguucaccgugagcugcagaguccugacccggcccucuccugauuuugacuucaucuuucucgugccgcccacaguugaaucccgcaccaaaccuuucagcgugcccguccugacgguggaggaaaugaccaauucuagauuuccuauuccccuugagaagcuguucacagggccguccagcgccuucguugugcagccucagaacggacgguguaccacagauggcguccuccuggggaccacgcaacugucucccgugaauaucugcacauuucgcggagacgucacccauauuacaggcuccagaaacuacaccaugaaucucgcuagccagaacuggaauaacuaugauccuaccgaggaaauccccgcgccucugggcacacccgacuucguggggaaaauccagggaaugcuuacgcagaccacacggaccgacggcuccacacgcgggcacaaggccaccguuuacacgggaucugcugauuuugccccgaagcugggcagagugcaauucgagacagacaccgaucaugacuuugaagccaaucagaacaccaaauucacaccugucggggugauucaggauggaagcaccacacaccggaaugagccccaacaguggguucuccccuccuacagcggccgcaacacgcacaaugugcaucuggcuccugccgucgcgccgaccuuucccggcgaacagcuucuguucuuuagaucuacaaugccuggguguuccggauaucccaacauggaccucgauugccugcugccucaggagugggugcaauacuucuaucaggaggcugcccccgcccagagcgacguggcucuccugcgguuuguuaauccugauaccggcagaguccuuuucgaauguaagcugcacaaaucuggguacgugacaguggcccauaccggacagcacgaccucgucauucccccgaacggcuauuuucgcuucgauagcugggugaaccaauucuacacgcuggcuccuauggggaauggcaccggacggagacgcguuguguga

SEQ ID NO: 27841 - RNA, 1623 nt, Artificial Sequence; identical to SEQ ID NO: 27045
  derived and/or modified sequence opt5 from VP1__Norovirus__BAU24933

SEQ ID NO: 27842 - RNA, 1623 nt, Artificial Sequence
  derived and/or modified sequence opt5 from VP1__Norovirus__BAU24936
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucggaacagacaccgaaaacgauuuugagacccaucaaaauacaaaguucacccccgugggcgucauucaggacggcgggacaacgcaccgcaacgaaccccagcaaugggugcugccuucuuacagcggaagaaauguuccgaacgugcaccuugcccccgcugucgccccuaccuuucccggcgagcagcuccuguucuuucgguccacaaugccuggguguagcggauaucccaauauggaucuggacugccugcucccucaggagugggugcagcauuucuaccaagaagcggcucccgcccagucugauguggcccugcuucgcuuuguuaacccggacaccggcagaguccuguucgaguguaaacuccacaagccuggguaugugacaguggcucauaccggccagcacgaucuggucauucccccuaacggauacuuucgguucgacuccugggugaaucaguucuauacgcuugcccccaugggcaacgggaccggaagacgccgggcucuguga

SEQ ID NO: 27843 - RNA, 1623 nt, Artificial Sequence
  derived and/or modified sequence opt5 from VP1__Norovirus__BAU24942
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaaccccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucgggacuuugaagccaaccagaauacaaaauucacccccguuggggugauccaggauggaagcacaacgcaucgcaacgagccccaacaguggguccucccuuccuacagcggcagaaauaccccgaacgugcaccuggcucccgccguggcgccuacauuucccggcgaacagcuucuguucuuucggucuaccaugccuggguguuccggauaucccaauauggaccucgauugccugcugccucaggaguggguucaauacuucuaucaggaggcugcccccgcccagagcgacgucgcucuccugagauuugugaacccggauacaggccgcgugcuuuucgaauguaagcugcacaaaucuggguacgucaccguggcccauacgggacagcacgaccucguuaucccucccaauggcuauuuucgguucgauagcugggugaaccaauucuacacccuggcuccuauggggaacggcacaggaagacgccgggcccuuuga

SEQ ID NO: 27844 - RNA, 1623 nt, Artificial Sequence
  derived and/or modified sequence opt5 from VP1__Norovirus__BAU24945
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucacagucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaaccccugcgccccugggcacgccggacuucguugggaaaauucagggagugcuuacccagacaacccggacagacggcuccacccgcgggcacaaggccacggucuacacaggaucugcugauuuugccccuaagcugggcagagugcaauucgagaccgacaccgaucaugacuuugaagccaaccagaauacaaaauucacccccguuggggugauccaggauggaagcacaacgcaccggaacgagccccaacaguggguccucccuuccuacagcggccgcaauaccccgaacgugcaccuggcucccgccguggcgccuacauuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacgggacagcaugaccucguuaucccucccaauggcuauuuucgcuucgauagcugggugaaccaauucuacacccuggcuccuauggggaacggcacaggacggagacgcgcccuuuga

SEQ ID NO: 27845 - RNA, 1623 nt, Artificial Sequence
  derived and/or modified sequence opt5 from VP1__Norovirus__BAU24948
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccgcucaccggaacgagccccaacaguggguccucccuuccuacagcggccgcaauacaccgaacgugcaccuggcccccgcgguggcuccuacguuucccggcgaacagcuucuguucuuuagaucuaccaugccuggguguuccggauaucccaauauggaccucgauugccugcugccucaggaguggguucaauacuucuaucaggaggccgcccccgcucagagcgacgucgcccuccugcgguuugugaacccggauacaggcagagugcuuuucgaauguaagcugcauaaaucuggguacgucaccguggcucacacaggacagcaugaccucguuauuccucccaauggcuauuuucgcuucgauagcugggugaaccaauucuacacccuggccccuauggggaacggcacgggacggagacgcgcgcuuuga

SEQ ID NO: 27846 - RNA, 1623 nt, Artificial Sequence; identical to SEQ ID NO: 26482
  derived and/or modified sequence opt5 from VP1__Norovirus__BAU24950

SEQ ID NO: 27847 - RNA, 1623 nt, Artificial Sequence; identical to SEQ ID NO: 27407
  derived and/or modified sequence opt5 from VP1__Norovirus__BAU24952

SEQ ID NO: 27848 - RNA, 1623 nt, Artificial Sequence
  derived and/or modified sequence opt5 from VP1__Norovirus__BAU24954
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcgccccggacuucguugggaaaauccagggaaugcuuacacagacgacccgggcugacggcagcacacgcgggcacaaggccaccguguacacaggauccgccgauuuugcuccuaagcugggcagaguccaauucgagaccgacacggaucaugacuuugaagccaaucagaacacaaaauucacccccguggggguuauccaggauggaucuaccacacaccggaaugagccccaacagugggugcucccuagcuacuccggccgcaacacccacaauguccaucuggcgccggcuguggcccccacauuuccuggcgaacagcuucuguucuuuagaagcacgaugcccggguguucuggauauccuaacauggaccucgauugccugcugccccaggagugggugcaauacuucuaucaggaggccgcuccugcccaguccgacguugcucuccugcgguuugucaaucccgauaccggcagagugcuuuucgaauguaagcugcacaaaagcggguacgugacagucgcccauaccggacagcacgaccucgugauuccgccuaacggcuauuuucgcuucgauucuuggguuaaccaauucuacacacuggcgcccauggggaauggcgccggacggagacgcguggucuga

SEQ ID NO: 27849 - RNA, 1623 nt, Artificial Sequence; identical to SEQ ID NO: 27085
  derived and/or modified sequence opt5 from VP1__Norovirus__BAU24958

SEQ ID NO: 27850 - RNA, 1623 nt, Artificial Sequence
  derived and/or modified sequence opt5 from VP1__Norovirus__BAU24960
augaagauggccagcaacgacgcuaaucccuccgauggcccugccgcgaaccuggugccggaggucaauaacgaaguuauggcucucgagcccguggugggggccgccaucgcugccccugucgcuggacagcaaaaugugauugaccccuggaucagaaacaauuucguucaggccccuggcggggaauuuaccgugucuccccggaacgcgccuggagagauucuguggagcgccccgcuuggccccgaucugaauccuuaccucucccaccuggcucgcauguauaacggguacgccggaggcuucgaaguccaggugauccuugcuggcaaugccuuuacagcggggaaaauuaucuucgccgcuguucccccuaacuuucccacggagggacugucuccgagccaggugaccauguucccucauaucauugucgacgugagacaacucgagcccgugcugaucccucugcccgauguccggaauaacuuuuaucacuacaaucaguccaacgacucuacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaaugcugacgcagaccacaaagggcgacgggucuacccggggacacaaggccacagucuacaccggcuccgccccuuuuacgcccaaacucgggagcgugcaguucgaaacagacaccgagaacgauuuugaaacccaucaaaauacaaaguucacccccguuggagugauucaggacggcggcacaacgcaccgcaacgagccucagcaauggguccugccguccuacucugggagaaaugugcccaacguucaccuugccccugcuguggcccccaccuuuccuggagagcagcuccuguucuuucggagcaucaugcccggcuguuccggguauccuaauauggaucuggacugccugcucccccaggaauggguccagcauuucuaccaagaggcggcuccggcccagagcgauguggcccugcuucgcuuugugaacccugacacaggaagaguucuguucgaauguaaacuccacaagucuggcuaugucaccguggcucauacagggcagcacgaucuggugauucccccuaacggcuacuuucgguucgacuccugggucaaucaguucuauacccuugcccccaugggaaacggcacggggagacgccgggcucuguga

SEQ ID NO: 27851 - RNA, 1623 nt, Artificial Sequence; identical to SEQ ID NO: 27133
  derived and/or modified sequence opt5 from VP1__Norovirus__BAU24962

SEQ ID NO: 27852 - RNA, 1623 nt, Artificial Sequence; identical to SEQ ID NO: 27812
  derived and/or modified sequence opt5 from VP1__Norovirus__BAU24964

SEQ ID NO: 27853 - RNA, 1623 nt, Artificial Sequence; identical to SEQ ID NO: 27812
  derived and/or modified sequence opt5 from VP1__Norovirus__BAU24966

SEQ ID NO: 27854 - RNA, 1623 nt, Artificial Sequence
  derived and/or modified sequence opt5 from VP1__Norovirus__BAU24968
augaagauggccagcuccgacgcuaaccccucugauggcagcaccgccaaucuggugccugaggucaacaaugaaguuauggcgcucgagccggugaucggggcugccauugccgcucccguggccggacagcaaaacgucaucgacccuuggauuagaaauaacuucgugcaggcucccggcggggaauuuacaguuuccccucggaaugcccccggagagauccuguggucugcgccucuuggcccggaucugaaccccuaccucagccaccugucccgcauguauaauggguacgccggaggcuucgaagugcaggucauucuugcuggcaacgccuuuacggcugggaaaaucaucuucgccgcggugccucccaauuuuccuaccgagggacugucucccagccagguuacaauguucccgcauaugauuguggacgucagacaacucgagccugugcugaucccccugccugaugugcggaacaauuuuuaucacuacaaccaguccaaugacagcaccauuaagcucaucgccaugcuguauacaccccuucgcgcuaacaacgccggcgaugacgucuucaccguuucuugcagagugcugacacggcccuccccugauuuugacuucauuuuucucgugccgcccaccgucgaaagccgcacgaaaccuuucucugugcccguucugaccguggaggaaaugacaaauuccagauuuccuaucccccuugagaagcuguucaccgggccgagcucugcuuucgucgugcagccucagaacggacgguguacaaccgauggcguucuccuggggacgacacaacugucccccgugaauauuugcaccuuucgcggagacgucacacauaucccuggcagcagaaacuacaccaugaaucucgccucccagaacuggaacucuuaugaucccaccgaggaaaucccugcuccccugggcacaccggacuucguggggaaaauucagggaguccuuacgcagaccacacggaccaauggcagcacacgcgggcacaaggccaccguguacacgggauccgcggacuuuagcccuaagcugggcagaguucaauucgccacagauaccgacaaugauuuugagaccaaccagaauacaaaauucacccccgugggggucauccaggacggaucuacaacgccccggaacgaaccucaacagugggugcucccguccuacagcggccgcaauauucauaacguucaccuggcucccgccguggccccuaccuuucccggcgagcagcuucuguucuuuagaucuacaaugccuggguguagcggauaucccaauauggaucucgacugccugcugccucaggaauggguccaauacuucuaucaggaggcugcccccgcgcaguccgauguggcucuccugcgguuugugaacccggacaccggcagaguucuuuucgaguguaagcugcacaaaucuggguacgucacaguggcccauaccggacagcacgaucucgugaucccucccaacggcuauuuucgcuucgacagcugggucaaucaauucuacacgcuggccccuauggggaacggcaccggacggagacgcgcucuuuga

SEQ ID NO: 27855 - RNA, 1623 nt, Artificial Sequence
  derived and/or modified sequence opt5 from VP1__Norovirus__BAU24972
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacaucacccauauuacaggcucuagaaacuacaccaugaaucucgcuucccagaacuggagcaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaacauuucuaccaggaggcugcccccgcccagagcgacguugcucuccugcgguuugucaacccggauaccggcagagugcuuuucgaauguaagcugcacaaaucuggguaugugacagucgcccauaccggacagcacgaccucgugaucccucccaauggcuacuuucgcuucgauagcuggguuaaccaauucuauacgcuggcuccuauggggaacggcaccggacggagacgcgcccuuuga

SEQ ID NO: 27856 - RNA, 1623 nt, Artificial Sequence
  derived and/or modified sequence opt5 from VP1__Norovirus__BAU24974
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaagcaccacacaucgcaacgagccccaacaguggguccucccuuccuacagcggcagaacgaccccgaaugugcaccuggcucccgccguggcgccuacauuucccggcgaacagcuucuguucuuucggucuaccaugccuggguguuccggauaucccaacauggaccucgauugccugcugccucaggaguggguucaauacuucuaucaggaggcugcccccgcccagagcgacgucgcucuccugagauuugugaauccggauacaggccgcgugcuuuucgaauguaagcugcacaaaucuggguacgucaccguggcccauacgggacagcacgaccucguuauuccucccaacggcuauuuucgguucgauagcugggugaaucaauucuacacccuggcuccuauggggaacggcacaggaagacgccgggcccuuuga

SEQ ID NO: 27857 - RNA, 1623 nt, Artificial Sequence; identical to SEQ ID NO: 27141
  derived and/or modified sequence opt5 from VP1__Norovirus__BAU24976

SEQ ID NO: 27858 - RNA, 1623 nt, Artificial Sequence; identical to SEQ ID NO: 27133
  derived and/or modified sequence opt5 from VP1__Norovirus__BAU24978

SEQ ID NO: 27859 - RNA, 1623 nt, Artificial Sequence; identical to SEQ ID NO: 27133
  derived and/or modified sequence opt5 from VP1__Norovirus__BAU24980

SEQ ID NO: 27860 - RNA, 1623 nt, Artificial Sequence
  derived and/or modified sequence opt5 from VP1__Norovirus__BAU24982
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcuaacuuugccccuaagcugggcagaauccaauucgagacagauaccgaccaugauuuugaagccaaucagaacaccaaauucacacccguggggguuauucaggacggaagcaccacacaccggaaugagccccaacagugggugcucccuuccuacagcggccgcaacacgccgaauguccaccuggcucccgccguggcgccuaccuuucccggcgaacagcuucuguucuuuagaucuacaaugccuggguguuccggauaucccaacauggaucucgacugccugcugccucaggagugggugcaauacuucuaucaggaggcugcccccgcccagagcgauguugcucuccugcgguuugucaauccggacaccggcagagugcuuuucgaauguaagcugcauaaaucuggguacgugacagucgcccacaccggacagcaugaucucgugaucccucccaacggcuauuuucgcuucgacagcuggguuaaccaauucuacacgcuggcuccuauggggaauggcaccggacggagacgcgcccuuuga

SEQ ID NO: 27861 - RNA, 1623 nt, Artificial Sequence; identical to SEQ ID NO: 27133
  derived and/or modified sequence opt5 from VP1__Norovirus__BAU24984

SEQ ID NO: 27862 - RNA, 1623 nt, Artificial Sequence; identical to SEQ ID NO: 27085
  derived and/or modified sequence opt5 from VP1__Norovirus__BAU24986

SEQ ID NO: 27863 - RNA, 1623 nt, Artificial Sequence
  derived and/or modified sequence opt5 from VP1__Norovirus__BAU24988
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucgaaacagacaccgagaacgauuuugaaacccaucaaaauacaaaguucacccccguuggagugauucaggacggcggcacaacgcaccgcaacgagccccagcaauggguccugccuucuuacagcgggagaaaugugccgaacguucaccuugcccccgcuguggccccuaccuuucccggagagcagcuccuguucuuucgguccacagucccuggcuguagcggguaucccaauauggaucuggacugccugcucccucaggaaugggugcagcauuucuaccaagaggcggcucccgcccagucugauguggcccugcuucgcuuuguuaacccggacaccggaagaguccuguucgaauguaaacuccacaaguccggcuaugugacaguggcucauaccgggcagcacgaucuggucaucccucccaacggcuacuuucgguucgacagcugggugaaucaguucuauacgcuugccccuaugggaaacggcaccgggagacgccgggcucuguga

SEQ ID NO: 27864 - RNA, 1623 nt, Artificial Sequence
  derived and/or modified sequence opt5 from VP1__Norovirus__BAU24990
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggaauaacuaugaucccaccgaggaaauuccugcgccccugggcacaccggacuucguugggaaaauccagggagugcuuacgcagaccacaagaaccgacggcagcacacgggggcauaaggccaccgucuacacgggauccgcugauuuugccccuaagcugggccgcgugcaauucgagacagacaccgaucacgacuuugaagccaaucagaacaccaaauucacacccguuggggugauccaggauggaggcaccacacacagaaaugagccccaacaguggguccucccuucuuacagcggccggaacacgcauaaugugcaccuggcuccggccguggcgcccaccuuuccuggggaacagcuucuguucuuucgcuccacaaugcccggauguagcggcuauccuaacauggaccucgauugccugcugccccaggaguggguucaauacuucuaucaggaggcugccccugcccagucugacgucgcucuccugagauuugugaaucccgauaccgggcgggugcuuuucgaauguaagcugcauaaauccggauacgucacaguggcccacaccggccagcacgaccucguuauuccgccuaacggguauuuuagauucgauagcugggugaaccaauucuacacgcuggcucccaugggcaauggaaccggccgccggagagccgucuga

SEQ ID NO: 27865 - RNA, 1623 nt, Artificial Sequence
  derived and/or modified sequence opt5 from VP1__Norovirus__BAU24992
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucgggacuuugaagccaaccagaauaccaaauucacacccguuggggugauccaggauggaagcaccacacaucgcaacgagccccaacaguggguccucccuuccuacagcggcagauauacgccgaaugugcaccuggcucccgccguggcgccuaccuuucccggcgaacagcuucuguucuuucggucuacaaugccuggguguuccggauaccccaacauggaccucgauugccugcugccucaggaguggguucaauauuucuaccaggaggcugcccccgcccagagcgacgucgcucuccugagauuugugaauccggauaccggccgcgugcuuuucgaauguaagcugcacaaaucuggguaugucacaguggcccauaccggacagcacgaccucguuauuccucccaacggcuacuuucgguucgauagcugggugaaucaauucuauacgcuggcuccuauggggaacggcaccggaagacgccgggcccuuuga

SEQ ID NO: 27866 - RNA, 1623 nt, Artificial Sequence; identical to SEQ ID NO: 27139
  derived and/or modified sequence opt5 from VP1__Norovirus__BAU24994

SEQ ID NO: 27867 - RNA, 1623 nt, Artificial Sequence
  derived and/or modified sequence opt5 from VP1__Norovirus__BAU24996
augaagauggccagcuccgacgcuaaccccucugauggcagcgccgcgaaucuggugccugaggucuccaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucgggacuuugaagccaaucagaacaccaaauucacacccguuggggugauccaggauggauccaccacacaucgcaaugagccccaacaguggguccucccuagcuacucuggcagaaacacgccgaaugugcaccuggcucccgccguggcgccuaccuuucccggcgaacagcuucuguucuuucgguccacaaugccuggguguagcggauaucccaacauggaccucgauugccugcugccucaggaguggguucaauacuucuaucaggaggcugcccccgcccagucugacgucgcucuccugagauuugugaauccggauaccggccgcgugcuuuucgaauguaagcugcacaaaagcggguacgucacaguggcccauaccggacagcacgaccucguuauuccucccaacggcuauuuucgguucgauuccugggugaaucaauucuacacgcuggcuccuauggggaacggcaccggaagacgccgggcccuuuga

SEQ ID NO: 27868 - RNA, 1623 nt, Artificial Sequence; identical to SEQ ID NO: 27133
  derived and/or modified sequence opt5 from VP1__Norovirus__BAU24998

SEQ ID NO: 27869 - RNA, 1623 nt, Artificial Sequence
  derived and/or modified sequence opt5 from VP1__Norovirus__BAU25002
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugacuccacaauuaagcucaucgccaugcuguauacaccccuucgcgcuaacaacgccggcgaugacguguucaccgucagcugcagagugcugacccggcccucuccugauuuugacuucauuuuucucguuccgcccacaguggaaucccgcaccaaaccuuucagcguccccgugcugacgguugaggaaaugaccaauucuagauuuccuaucccccuugagaagcuguucacagggccguccagcgccuucgugguccagccucagaacggacgguguaccacagauggcgugcuccuggggaccacgcaacugucucccgucaauauuugcacauuucgcggagacgugacccauaucacaggcuccagaaacuacaccaugaaucucgcuagccagaacugguccaauuaugauccuaccgaggaaauucccgcgccucugggcacacccgacuucguugggaaaauccagggagugcuuacgcagaccacacggaccgacggcucuacacgcgggcacaaggccaccgucuacacgggaagcgcugauuuugccccgaagcugggcagagugcaauucgagacagacaccgaucaugacuuugaagccaaccagaauaccaaauucacaccuguuggggugauccaggauggauccaccacacaccggaacgagccccaacaguggguccuccccagcuacucuggccgcaauacgccuaacgugcaccuggcuccggccguggcgcccaccuuuccuggcgaacagcuucuguucuuuagauccacaaugcccggguguagcggauauccuaauauggaccucgauugccugcugccccaggaguggguucaauacuucuaucaggaggcugccccugcccagucugacgucgcucuccugcgguuugugaaccccgauaccggcagagugcuuuucgaauguaagcugcauaaaagcggguacgucacaguggcccacaccggacagcaugaccucguuauuccgccuaauggcuauuuucgcuucgauuccugggugaaccaauucuacacgcuggcucccauggggaacggcaccggacggagacgcgcccuuuga

SEQ ID NO: 27870 - RNA, 1623 nt, Artificial Sequence; identical to SEQ ID NO: 27085
  derived and/or modified sequence opt5 from VP1__Norovirus__BAU25004

SEQ ID NO: 27871 - RNA, 1644 nt, Artificial Sequence
  derived and/or modified sequence opt5 from VP1_protein__Norovirus__ADN84676
augaagauggccagcuccgacgcugcccccucuaccgauggcagcgcggggcuggugccugaggucaacaaugaaacaauggcucucgagccgguugugggagcuccccuggccgccccuguggccggccagcacaacaucauugaccccuggaucaaaaugaauuucguccaagcuccuaacggggaauuuacggugucccccagaaaugccccuggagagauucuucuggaucucgaacugggcccggaccuuaaccccuaccugucucaucucgcgcggauguauaauggguacgccggaggcauggagguucaggugguccuggcuggcaacgccuucaccgcugggaagaucauuuuugccgcggugccucccaauuucccugccgagaaccugagcgcugcccagguuacaaugugcccccacgugaucgucgaugugcgccagcucgaaccggugaugcugccuaugcccgacaucagaaauaaacuuuuucauuauaaccaagucgaugacccuaagcugcggcuccuggcuuaccuuuauacaccccugcgcgccaauaacgccggagaugacguuuucaccguguccuguagagugcucacccggcccacaccugauuuugaguucauguuucuggucccgcccaccguggaaucuaaaacgaagccuuucagccugcccaaucucacccuggacgagcuuuccaacagccgcuuuccugcucccauuguucagcuguacacaaacccgcacgauaaucucgugguccagccucagaacggcagaugcaccaucgacgggcugcuucaaggaacaacccagcuggugucuuguaauguuugcuccuuccggggcacgaugggggagggacagcccgcgagccauucugaagacgagauuaugccuauggccaucaacgugcagcgcgaaauuaugcucgagaaucuggauggcucccccuaugacccuacagaugacauccccgcuguccugggcagcccggauuuucaaggggugauguucggcauucucucucagagaaacaccgacggacagacacgggcccacgaagccaaggucgauacccgcgcugccagauucgcgccuaaacugggguuugugguugcuaccguggaguccacagacuuccacgccaaucaacccagccgguuuacgcccgucggacuuggcggggaugccaaccgcgacuucaaucaguggcagcugccugcuuacggaggcgcccucaccaacaauacaaaccuggcuccgcccgugaugccuguuuaccccggcgagcagcuucuguuuuucagaucccaacucccuucuagcgggggaguggucgccggcuggcuggauugucugcucccccaggaaugggugcagcacuuuuuccaggaguccgcgaccagccaaucuaauguggcccugguucgguaugucaacccuacaaccgggagagugcuuuuugaagcuaagcugcauaaacagggauuccucacgguggccgcuuccggcagcuacccccuggucgugccggccgacggguauuuucgcuucgagucuuggguuaaugaauuuuacacacuggcgccuaugggcaacggaagcggccggagacgcgcccgguga

SEQ ID NO: 27872 - RNA, 1623 nt, Artificial Sequence
  derived and/or modified sequence opt5 from VP1_protein__Norovirus__BAK68870
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcuccacaacgcaccgcaaugaaccccagcaaugggugcugccuagcuacucuggcagaaacguucacaaugugcaucuugccccggcugucgcccccaccuuuccuggggagcagcuccuguucuuucgguccacaaugcccggauguagcggcuauccuaacauggaucuggacugccugcucccccaggagugggugcagcacuucuaccaagaagcggcuccugcccagucugauguggcccugcuucgcuuuguuaaucccgacaccgggagaguccuguucgaguguaaacuccauaagagcggauaugugacaguggcucacaccggccagcacgaucuggucaucccgccuaacggguacuuucgguucgacuccugggugaaccaguucuauacgcuugcccccaugggcaauggaaccggcagacgccgggcucuguga

SEQ ID NO: 27873 - RNA, 1620 nt, Artificial Sequence
  derived and/or modified sequence opt5 from capsid__Norovirus__AAC54893
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacaucaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaagugaucuucgcggccguuccucccaauuuuccuacggagggacugucucccagccaggugaccauguucccgcauaucauugucgacgugagacaacucgagccugugcugaucccccugccugauguccggaacaauuuuuaucacuacaaccagucccaugacagcacacucaagcugauugcuaugcuuuauacaccccugcgcgccaauaacgcuggcgaugacguuuucaccgugucuugcagagugcucacccggcccuccccugauuuugacuucaucuuucuggucccgcccacaguggaaagccgcaccaaaccuuucacgguucccauucuuaccguggaggaaaugucuaacuccagauuuccuaucccccuggagaagcucuacacagggccgagcucugccuucgucgugcagccucagaauggacgguguaccacagauggcguucugcuggggaccacgcaacucuccgccgugaacauuugcaauuuccgcggagacgucacacacaucgugggcagccaugauuauaccaugaaccuggcuucccagaauuggucuaacuacgaccccacagaggaaaucccugcgccccuuggcaccccugacuuugucgggaaaauucagggacugcucacccagacaacgagagccgauggcagcacccgggcucacaaggccacaguguccaccgggagcguucacuucacacccaagcugggaucugugcaauuuaccacggacacaaauaacgauuuccagaccggccagaauaccaaauuuacaccggucggggugauccaagacggagaucaucaccagaacgagccucagcaguggguucuucccaauuacuccggccgcaccggccauaacgugcaccuggcccccgcugucgccccuacauucccgggggaacaacuccuguuuuucagaagcacgaugcccggauguucuggcuauccuaauaugaaccuggacugccuccugccccaggagugggugcuucacuuuuaccaggaagcggcuccugcccagagcgauguggcccugcuccgguucguuaaucccgacaccgggcgcguccuguuugaguguaaacuucauaaguccggauauauuacaguggcucacaccggcccuuucgaucuggugauucccccgaacggguacuuuagauucgacucuugggucaaccaauucuauacacucgccccuaugggcaauggaaccggccggagacgcgcucuguga

SEQ ID NO: 27874 - RNA, 1647 nt, Artificial Sequence
  derived and/or modified sequence opt5 from capsid__Norovirus__AAW30195
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagagcuuacggugucuccuagaaauagccccggcgaagugcugcucaaccuggagcuugggccugaaauuaauccguaccuggcccaccucgcucggauguauaacggauacgccggcggcuuugagguccaggugguucuggcugggaaugccuucaccgcgggaaaaaucaucuuugccgcuauucccccuaacuuccccaucgacaaucuguccgccgcucagauuacaaugugcccucaugugaucgucgaugugcgccaacucgagcccguuaaccugccgaugccugacgugagaaauaacuuuuuccacuauaaccagggcucugauacccggcuucgccugauugccaugcucuacacaccccugagagccaauagcuccggggacgaugucuuuaccgugucuugucgggugcuuacacgcccuagccccgacuucuccuuuaacuuccugguucccccuaccgucgaaagcaagacgaaaccguuuacccuccccauccugacaauuucugagauguccaauagcagauucccugugcccaucgauucucugcauaccuccccuacagaaaacaucgugguccagugccagaauggacgggugacccucgacggcgagcugauggggacgacacaacuucugcccagccagauuugugcuuuucgcggaaugcucaccagaucuacaucccgggcgagcgaucaggccgacaccgcugccccgcgccuguucaacuaucacuggcauauccagcuugacaaucugaacggcaccccuuacgaucccgccgaggacauuccuggcccccucgggacaccugauuucagaggaaagguuuuuggcguggcuucccaacggaaucccgacucuacgacccgcgcccacgaagcgaaagucgauacaaccgcugggagauucacaccgaagcugggaagccuggagaucuccaccgaaagcggcgaccucgaucagaaccagccuacgaaguuuacacccguggggauuggaguugaccacgaggaagauuuccaacaguggucucugcccgacuauuccggccaguuuacccauaauaugaaccuugccccugccguggcuccgaauuuccccggcgagcagcugcucuuuuuccggagccaacugccuucuagcgggggaagauccaacggcauccuugauugccuggucccccaggagugggugcagcacuuuuaccaggaaucugccccugcucaaacccaggucgcccucgugcgcuacguuaaucccgacacagggcgggugcuguucgaggcgaaacugcauaagcucggauuuaugaccaucgccaaaaacggcgacagcccuauuacagugcccccgaacggguauuucggcuuugaauccugggucaauccuuucuacacgcuggcucccaugggaaccggcaacgggagacgccggauccaguga

SEQ ID NO: 27875 - RNA, 1647 nt, Artificial Sequence
  derived and/or modified sequence opt5 from capsid__Norovirus__ABD36491
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaagugaucuucgcugccauucccccuaacuuucccaucgauaaucuguccgcugcccagaucaccaugugcccucaugucauuguggacguucgccaacuggaacccaucaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucacccugcccauccucacgauuucugaaauguccaacagcagauuuccugugcccaucgacucucugcauaccuccccuacagagaauaucgugguccagugccagaacggacgggugacccuggauggcgagcucauggggacaacccaacugcuucccagccagauuugugcguuccgcggaacgcugacaagaucuaccucccgggccagcgaccaggcugauacagccaccccgcgccucuucaauuauuacuggcacauccagcuggacaaccuuaauggcaccccuuaugaccccgccgaagauauuccugcuccccugggcacaccugacuuuagagggaagguuuucggaguggccucccaacggaaccccgauucuacgacccgcgcgcaugaggcuaaagucgacacaaccagcggcagauuugccccgaagcucgggucccuggaaaucagcacagagucuuccgauuucgacagcaaucagccuacccgguuuacgcccgugggaauuggcguugauaacgaagccgacuuccagcaauggucucugcccgauuacagcgggcaguuuacacacaauaugaaccucgcuccugccguggcuccgaauuuccccggagagcagcugcuguuuuucagaucccagcuuccuucuagcggcggccgcuccaacgggauccucgacugccuggucccccaagagugggugcagcacuuuuaccaggaaagcgccccugcgcagacccaagucgcccuugugcgguauguuaaccccgauaccggaagagugcuguucgaggcuaagcuccauaaacugggcuuuaugacaaucgccaagaauggggacucuccuauuaccgugcccccgaacggauacuuccgcuucgaauccugggucaauccuuuuuauacacuggcucccaugggcacggggaacggccggagacgcauccaguga

SEQ ID NO: 27876 - RNA, 1629 nt, Artificial Sequence
  derived and/or modified sequence opt5 from capsid__Norovirus__ABD36494
augaagauggccagcaacgacgcugcccccuccaaugauggcgcggcuucucuggugccugaggggaucaacgaaaccaugccgcucgagcccgucgccggagccagcauugcugccccuguugcuggccagacaaauaucauugaccccuggaucagaacgaacuucgugcaagccccuaauggggaauuuaccgugucuccccggaacuccccuggagagauucugcuuaaucuggaacucggcccggaucugaaccccuaccuugcgcaccugagccgcauguauaauggguacgccggaggcgucgaggugcagguucuccuggcuggcaacgccuucacagcugggaaaauccuguuugccgcgaucccucccaauuucccuguggacaugauuucccccgcccagaucaccaugcucccgcaucugauugucgaugugagaacacuugagccuaucaugauuccccugccugacguucggaacguguuuuaucacuucaauaaccagccccaaccccgcaugagacucgucgcuaugcuguacaccccucuucggucuaauggaagcggcgaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcccccaacgagaauaacgugguccagugucagaaugggcgcugcacgcuugacggagaacugcaaggcacaacccagcuccugucuuccgcuaucuguagcuauagagggcggacaguggccaacaauggagauaacugggaccagaaucuucugcagcucaccuacccuaacggcgccucuuacgaucccaccgacgagguuccugcuccccugggcacacaagacuucuccgggaugcuguauggagugcucacgcaggauaauaccaacgucagcgcgggcgaagccaagaaugcuaaagggauuuacaucuccacaaccucuggaaaguuuacaccgaagauuggcagcaucgggcugcauuccaucaccgagcacguguauccuaaccagcaaagccgcuucacgcccguuggaguggccgucaaugaaaacacacccuuccagcagugggugcuuccucauuacgccggcucucuggcucucaauaccaaccuggccccggcggucgcucccaccuuuccuggcgagcagcuucuguucuuuagaucccgggugcccugcguucaagggcagcagggacaggacguguucauugauugucuccugccucaagagugggucaaccacuuuuaucaggaagccgcccccagccaggcugacguggcccugauccgcuacguuaauccugauacaggcagaacccucuucgaggcuaaacugcaccggucuggguuuauuacagugagccauacgggagccuauccccuugucgugccgccuaacggccacuucagauuugacuccugggugaaucaguucuacucucuggcgcccauggggaccggcaacggacgccggagaauccaauga

SEQ ID NO: 27877 - RNA, 1614 nt, Artificial Sequence
  derived and/or modified sequence opt5 from capsid__Norovirus__ABD36497
augaagauggccagcaacgacgcugcccccuccucugauggcgcggcugggcuggugccugagaucaaucacgaagucauggccauugagccgguugccggagcuagcaucgccgcucccguggugggccagcaaaacauuaucgacccuuggauuagaaauaacuucguccaggcccccgcgggggaauuuaccguguccccucggaaugcccccggagaguuccuccuggaucuugaacugggcccugaccucaacccguaccuggcucaucuugcccgcauguauaaugggcacgcuggaggcauggagguucagaucgugcuggccggcaacgcguuuacagccgggaaaauccucuucgcugucauucccccuggauuucccuacgagaaucugucuccugcccagcugacgaugugcccccaugugguuguggaugucagacaacucgaaccggugaugcugccuaugcccgacauccggaacaccuucuuucacuauaaucaggauggcgggccucgccuuagacugauugcuaugcucuacacaccccugcgggccaacaauagcggagacgauguguucaccgucuccugucgcguucuuacaagacccgccccugacuuugaguucaccuuucuggugccgcccucuguggaaagcaagacaaaggcuuucaccaucccuguccucaaaauuuccgagaugacgaacagccgguuucccgugccuguugaucagauguauaccucucgcuccgagggcaucgugguccagccccaaaaugggagagcgacaauugacggagaacugcugggcaccacacucgugagcccgguuucugugugcaacuucaaaggcaaccugcagaccgaggucccugggcagcaucagcaauaccagcuucagcugacgaaucucgauggaucccccaucgacccuacagacgauacccccggcccucuggggugucccgacuucaucggacuucuguauggcguggccagccaacgggggccgggagaugcuacacgcgcccacgaagccagaauugacaccggcucugauaccuacgcuccuaagaucggccagguccgguuuuacuccacaagcaacaauuucgagacgaaccagcccacccacuuuacacccguggggguuuauauugaaggauccucuagcgacuucaaucaguggcaacucccucgcuacggcgggcaucuggccaacaauaaccaccuggcgccggcugugagcccccucuuuccuggagagcagauccuguucuuuagauccuucauucccggcgccucugggcauaccaauggcgagauggauugccuucugccucaggaauuuguccagcacuucuaucaagaggccgcuacagcccaguccgaaguggcucuccugcgguuuguuaaccccgacaccggaagagugcuuuucgagagcaagcugcacaaacagggcuuuaugacgaucgccucuagcggggaucauccuaucauuaugcccacaaauggauacuuccgcuucgaagcgugggucaaccaguuuuauucccucgccccggugggcaccgggucuggacggagacgcauccaauga

SEQ ID NO: 27878 - RNA, 1623 nt, Artificial Sequence
  derived and/or modified sequence opt5 from capsid__Norovirus__ABL74387
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugaggcugggcagaacaccagauucacacccgucggagugguucaagauggcuccacgacccaccagaaugaaccccagcagugggugcucccugacuacagcggccgggauucucacaacguccaucuggccccggccguggcucccacauuuccuggggagcaacuucuguucuuucgcuccaccaugcccggauguagcggcuacccuaauaugaaccucgacugccugcugccccaggaaugggugcagcacuucuaucaggagucugccccugcgcaaagcgauguugcucuccugagauuugucaaucccgacacagggcgggugcuuuucgaguguaaacugcauaaguccggauacgugaccgucgccuauacgggccagcacgaucucgugauuccgccuaacggguacuuuagauucgacucuuggguuaaccaguucuauacccuggcccccaugggcaauggagcuggccgccggagagcccuuuga

SEQ ID NO: 27879 - RNA, 1623 nt, Artificial Sequence
  derived and/or modified sequence opt5 from capsid__Norovirus__ABL74389
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauucgccucaucgcuaugcuguauacaccccuuagagccaacaacgcuggcgaugacguuuucaccgugagcugccgggugcugacccgcccuuccccggauuuugacuucauuuuucucgugcccccuacggucgaaagcagaaccaagcccuucucuguuccuauccugacaguggaggaaaugaccaauucccgguuucccauuccgcuugagaaacuguucacagggccuagcucugccuucgucgugcagccccagaacggacgcuguaccacggauggcguucuccuggggacaacccaacuguccccugugaauaucugcacauuuagaggagacgucacccauaucgccggcacccagaacuacacaaugaaucucgcuagccagaacuggaauaacuaugaucccacggaggaagugccugcgccccugggcaccccggacuucgucgggaagauucagggagugcuuacacaaaccacacggggcgacgggucuacccgcggacacaaagccacgguuuccacaggcagcgugcauuuuaccccuaagcugggguccguccaguucucuaccgauacaagcaaugacuuugagaccggacagaacacaagauucacgcccgugggcguugugcaagauggcuccaccacacaccagaaugaaccccagcaguggguccucccugacuacagcgggcgggauaaccacaaugugcaucuggcuccggccguggcccccaccuuuccuggagagcaacuucuguucuuucgcucuacaaugcccggcuguuccggguacccuaacaugaaucucgacugccugcugccccaggaauggguucagcacuucuaucaggagagcgcuccugcccaaucugaugucgcgcuccugagauuugugaaccccgacaccggacgggugcuuuucgaguguaagcugcauaaaagcggcuacgucacgguggcucacaccgggcagcacgaucucguuaucccgccuaacggcuauuuuagauucgacuccugggugaaucaguucuacacacuggcccccaugggaaacggcgccgggcgccggagagcucuuuga

SEQ ID NO: 27880 - RNA, 1623 nt, Artificial Sequence; identical to SEQ ID NO: 26932
  derived and/or modified sequence opt5 from capsid__Norovirus__ABL74397

SEQ ID NO: 27881 - RNA, 1593 nt, Artificial Sequence
  derived and/or modified sequence opt5 from capsid__Norovirus__ABQ44562
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuggcaugggcauuucccccgauaauguucaaagcgugcaguuucagaacgggcgguguacacuugacggacgccuggucggcaccacaccugugucccucucucauguugccaaaaucagagggaccagcaauggaaccgugauuaaccugacagaacuugacggcacgcccuuccacccguucgaggggccugcccccaucggauuuccugaucugggcggcugcgacuggcacaucaauaugacccaguucgggcauuccagccaaacacaguacgaugucgacaccacacccgauaccuuugugccucaccucggaucuauucaggcuaacggcgucuccagcgggaauuauaucggagugcugucuuggguuagcccgcccucccauccuucuggcagccaaguggaccuguggaagauucccaacuacggguccagcaucacggaggccacacaccucgcccccucugucuauccuccgggcuucggagaagugcugguguuuuucauguccaaaauucccggcccuggggcuuacagccuucccugucugcucccucaggaguauaucucucaccuggcguccgaacaggcccccaccguuggagaggcugcccuucugcauuacgucgauccugacaccggccggaaucucggggaguuuaaggccuaccccgauggauuccugacaugcgugccgaacggcgcuagcuccgggccucagcaacugcccaucaauggcguguuuguuuucgucucuugggugagccgcuuuuaucagcucaagccugugggaaccgccuccacagcgagaggccggcuggggcuucgcagauga

SEQ ID NO: 27882 - RNA, 1638 nt, Artificial Sequence
  derived and/or modified sequence opt5 from capsid__Norovirus__ABQ44563
augaugauggccagcaagggcgcucccaccaacauggacgggacauccggagccggccagcuggugccugaggcgaauacggcugaaccgaucucuauggagcccgucgccggggccgcuaccgccgcugccacagcgggacaaguuaacaugauugauccuuggaucaugaauaacuacgugcaggcuccccagggcgaguucaccauuagcccuaauaacacacccggggacauccucuuugaucugcagcuuggaccucaccugaauccguuccucucccaucuggcccaaauguauaacggcugggugggcaauaugaaagucaaggugcuucuggccgggaacgcuuuuaccgccggaaaaauuaucaucucuugcauucccccuggcuucguugcgcagaauaucagcauugcccaggcuacaauguuuccccacgugaucgccgacgucagagugcucgaaccuauugaaguuccccuggaggaugugcggaacguccuguuccauaauaacgacaauaccccgacgaugcgccucguguguaugcuguacaccccucuuagagcuuccgggucuagcuccggaacagaucccuuugugaucgccggccggguccugaccugcccuagccccgacuucucuuuucucuuccugguucccccuaacguggagcagaagacaaaaccguuuuccgugcccaaccuuccucugaauacccucagcaacucucgcguccccucccugauuaagagcaugauggugucuagagaucacgggcaaaugguucaguuccagaauggacgggugacgcuggacggccagcuccaaggcacaaccccuacauccgccagccagcuguguaagauccgcggguccgucuuucaugcuaacggaggcaauggguauaaccuuaccgaacuggauggaucucccuaccacgcguucgagagcccggccccuaucggcuuccccgaccucggggaaugcgauuggcacauggaggcuuccccuaccacacaguuuaauacgggagacgugauuaaacaaaucaacguuaagcaggagagcgccuucgcuccccaucugggcaccauucaggccgacggccuuucugauguguccgucaauacaaacaugaucgccaaacuggaaugggugagcccugucucugacgggcacaagggagauguggaccccuggguuauuccgagauauggcagcacccucacagaggcggcucagcuggccccucccaucuaucccccuggguuuggagaagccaucguguucuuuauguccgauuucccgauugcucauggcaccaaugggcugucuguccccuguacgaucccucaagaguuugugacacacuucguuaacgaacaggcccccacccggggcgaggcugcccuccugcacuaccuugacccugauacccaucgcaaucugggagaguuuaaacucuaccccgacggcuucaugacaugcgugccuaacagcuccgggaccggaccccagacacugccgauuaauggcgucuuuguguucgugagcuggguuucuagauuuuaccagcuuaagccugucgggacggcgggacccgcccggcgccugggcaucagacgguccuga

SEQ ID NO: 27883 - RNA, 1635 nt, Artificial Sequence
  derived and/or modified sequence opt5 from capsid__Norovirus__ABQ44564
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgaggucagcaagauccccaauuccucuacccagagcaacccgauuguggucaauuccgugaagccuaacagccagcaguucguuccccaucucucuuccaucacacuggaugacaaugugagcucuggaggcgauuacauuggcaccauccaauggacgagcccucccuccgacucugggggagcuaacacaaauuuuuggaaaauuccggauuauggcagcucccuggcggaagccagccagcucgcucccgccgucuacccucccggguucaacgaggugaucguuuauuuuauggccucuaucccuggacccaaucaguccggcagcccuaaccuggugcccugucuucugccgcaggaauacauuacccacuucaucucugagcaagcuccuauucagggggaggccgcgcuccugcacuacgucgaccccgauaccaaucggaaccuuggcgaauuuaagcuguauccuggaggcuaccucacaugcgugcccaauuccagcuccaccgggccgcagcagcugccucuggacggaguguucguuuuugcuucuugggucagccgcuucuaucaacucaaacccgugggcacagccgggccugccagaggacggcugggcgugcgcagauga

SEQ ID NO: 27884 - RNA, 1623 nt, Artificial Sequence
  derived and/or modified sequence opt5 from capsid__Norovirus__ABQ44565
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacgucccccugaaagaucucuccaauagcagagugccuguucccauucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggucuccguuuaucccucuugaaagccccgcgccugucggauuccccgaccugggcgggugugauuggcacgugaauuuuacauuccaggcccaagaccaggauccuucccagagcgucaccuuugcuaccaacgacgccucuuucgugcccuaccucggauccaucagcccgcauaauggcggcgauuuucacucuggggacauuaucggaagccugggcuggauuuccgccccuucugauagcucccagcugaacguuuggacaauccccaaguaugggagcucucuccccgacgugacgcaccuggcuccugccgucuucccgcccggauuuggcgaggugauucuuuacuucuauuccaccuuuccugggagcggccaacccggacagcugcagguuccuugccuccugccccaggaguucaucacacauuuuuguaaugaacaagcgccuaucgcuggcgaggccgcccuucugcacuacguggaucccgacaccgggcggaaccucggagaguucaagcuguauccggauggcuucaugacaugcgucccuaauucuguguccagcgggccccagacccugccuauuaacggaguguuuguuuucgucuccugggugucucgcuuuuaccagcucaaacccgugggcacggcuagcgucgccagacggcuggggcuucgcagaaucuga

SEQ ID NO: 27885 - RNA, 1635 nt, Artificial Sequence
  derived and/or modified sequence opt5 from capsid__Norovirus__ABQ44566
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgaggugccccuggaagauguccgcaaugugcuguuucacacgaacgacaauagaccgaccaugcggcucguguguaugcuguauacaccucuucgcgcuaacggcucuagcuccgggaccgaucccuucgucauugccggaagaguucugacaugcccugacagcaauuuuucuuuccucuuucuggugccucccaacguggagcagaaaacccggcccuucuccgucccgaacaucccccuuaauacgcugagcaacucucgcgugccuucccucauuaagagcaugacaaucucuagagaucaaaaucagaucauucaguuucaaaacggccggguuacccuggacgggcagcugcagggaacaacccccaccuccgugagccaacucuguaaaauccgcggcacaacguaccaugcuaccggcgggaauggaauuaaccugacagagcuuaauggcgaaccuuaucacgccuucgagucccccgccccgaucggguucccugaucugggaggcugcgacuggcaucucaccgcuacacccacccaggcguuuaacgacggggccaaggucgugagacugucuguuacgcagggagcugccuucgccccucaccuuggcacaauucacuacaccaccacagauaccgacuauagccccaauacauccaucaucuguacgcuggauuggcucagccagaccacaggccaaucuaacguggacccuuggcagauucccaccuacggguccacacugaccgaagcugcccagcuggcgccgccuaucuuuccucccggauucggcgagacgcucgucuuuuuccugagcgauuuucccauuucuaaugggaagaacggacuuagcgugccgugcacccugccccaggaguucgucacacauuuugugaaugaacaagcuccuauccggggcgaggccgcccuccugcacuauguugaccccgauacccaucgcaaccuuggggaguucaaacuguacccugaaggcuuuaugacaugugugcccaauaccuccggaggcgggccucagacgcuccccauuaacggagucuucguguuuguuucuugggugagcagauucuaccagcugaagccggucggcacagcuggggccgcucggcgccugggaaucagacgguccuga

SEQ ID NO: 27886 - RNA, 1608 nt, Artificial Sequence
  derived and/or modified sequence opt5 from capsid__Norovirus__ABQ44567
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaaacucgucuucgccgcgauucccccucauuuucccaucgaaaaucugagcccuggacagaucacaauguucccccacgugaucauugauguuagaacccuugagccggugcugcucccucugcccgacguccggaacaacuuuuuccauuacaaucaggaaccugagccccgcaugagacuuguggccaugcuguauacaccccuccgguccaacggcucuggggaugacguguuuaccgucagcugccgcguucugacaagaccuuccccggauuucgacuuuaauuaccuggugcccccuaccguggagagcaagacgaaacccuucacccucccuauccugacaauuggagaacuuucuaacucccgguuucccgcuccgaucgaugagcuguauaccagcccuaaugaaggccucgucgugcaaccccagaacgggcgcucuacacuggacggagagcuucugggcaccacgcagcucguuccuuccaauauuuguagccugagaggccggaucaacgcccaccuucccgauaaucagcaucgcuggaacaugcaagugacaaaugcuaacgggaccccuuucgaccccacagaagaugucccggccccucucggaacccccgacuuccuggccaauauuuacggcgugaccucucagagaaaccccgacaauacaugccgggcucacgaugggauccuugcgacgugguccccuaaguuuaccccgaaacugggaagcguugugcucggcacaugggaggaccgcgauuucgacaucaaccagcccaccagauuuacaccugucgggcuguaugauaccgaccacuucaaucagugggcccuucccaacuacuccggagcucugacgcucaacaugaaucuggccccuucuguggcuccccuguuuccuggcgagcaacuccuguucuuucggagccauauuccccuuaagggcgggacauccagcggagccaucgauugucugcucccgcaggaauggguccagcacuucuaccaagagucugccccuuccagcaccgacguggcgcugauuagauauaccaaccccgauacaggccgcguucuguuugaagcuaagcugcaucggcagggguucaucaccguggccaauucuggaagcagaccuauugucgugcccccgaacggcuacuuucgcuucgacuccuggguuaaucaguuuuauucucucgccccuauggggacaggcaacggacggagacgcgugcaguga

SEQ ID NO: 27887 - RNA, 1629 nt, Artificial Sequence
  derived and/or modified sequence opt5 from capsid__Norovirus__ABQ44568
augaacauggccagcaaugacgcugcccccuccaccgauggcgcggcugggcuggugccugagucuaacaaugaagucauggcccucgagccgguugccggagcugcccuggcugcccccgugacaggccagacgaacaucauugacccuuggaucagagcgaauuucgugcaagcccccaacggggaauuuaccgucagcccucggaaugcucccggagaggugcuucugaaccucgaacugggcccugagcuuaauccguaccuggcccaccucgcucgcauguauaacggguacgccggaggcauggagguucaggugaugcuggcgggcaaugccuucacagcugggaagcuggucuuugccgcugugcccccucauuuccccguugaaaaccucuccccucagcagauuaccauguuuccccacgugaucauugaugucagaacacuggagccggugcuucugccucuccccgacgugcggaauaacuucuuucauuauaaucaaaaagaugacccuaagaugcgcaucgucgccaugcuguacacaccccuuagaucuaacggaagcggcgaugacguuuucaccguguccugccgggugcugacccgccccucuccugauuuugacuucacguaucucgucccgcccaccguggaaagcaaaacaaagccuuuuacccugcccauccugacacucggggagcuguccaacagcagauucccuguuucuauugaucagauguacaccucccccaaugaggugaucagcguccagugucagaacggacggugcacgcuugacggcgaacugcaagggacaacccagcuccaggugucuggaauuugugccuuuaaaggcgagguuacagcucaucugcacgauaaugaccaccuuuauaacgugaccaucaccaaucugaacggcuccccguucgacccuagcgaagauauucccgcgccucucgggguccccgacuuccagggacgcguguuuggcgucaucucucaaagagauaagcagaaugccgcugggcacaacgagccugccaaucggggacaugacgccgugguucccacauacacggcucaguacaccccgaagcugggccaaauucagaucgggacauggcagaccgaugaccugacagugaaccagccugucaaauucacccccgugggacucaaugauacggaacacuuuaaccaauggguugugccccgcuaugccggcgcgcugaaucuuaacacaaaucuggcuccuuccgucgccccgguguuccccggcgagagacuccuguuuuuccggagcuacaucccucuuaaagggggauauggcaaccccgccauugacugccugcucccucaggagugggugcagcauuuuuaccaggaagcugcccccuccaugucugagguugcucugguccgcuauaucaacccugauaccgggagagcccuguucgaagcgaagcuccaccgggccggauuuaugaccgugagcuccaauacaagcgcucccguggucgugccggccaacggcuacuucagauuugacucuuggguuaaucaauucuauucccuggcuccuauggggaccggcaacggacgccggagagugcaguga

SEQ ID NO: 27888 - RNA, 1647 nt, Artificial Sequence
  derived and/or modified sequence opt5 from capsid__Norovirus__ABQ44569
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaaaucaucuucgcugccauucccccuaacuuucccaucgacaaucuguccgcugcccagauuaccaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgauucucugcauaccuccccuacagaaaauaucgugguccagugccagaacggacgggugacccuggacggcgagcucauggggacaacccaacugcuucccagccagauuugugcguuccgcggaguucugacgagaucuacaucccgggccagcgaucaggcugacaccgccacaccgcgccucuucaauuauuacuggcacauccagcuggacaaccuuaauggcaccccuuaugaucccgccgaggacauuccuggcccccuggggaccccugauuuuagaggaaagguguucggcgucgcuucccaacggaaccccgacucuacaacgcgcgcccaugaagcgaaaguggauaccacagcugggagauuuaccccgaagcucggaagccuggagaucuccacagaaagcgacgauuucgaccagaaucagccuacccgguuuacgcccguuggcauugggguggaucacgaggccgacuuccaacaguggucucugcccgauuacuccggacaguuuacacacaacaugaaucucgccccugcugucgccccgaacuuccccggcgaacagcugcuguuuuucagaagccaacuuccuucuagcggcgggcgcuccaauggaauccucgacugccuggugccccaggaguggguccagcauuuuuaccaggagucugcuccugcccaaacccagguggcgcuuguucgguaugugaaccccgacaccggcagaguccuguucgaagccaagcuccacaaacugggguuuaugacaaucgcuaagaacggagauagcccuauuaccgugcccccgaauggcuacuuccgcuucgaguccuggguuaacccuuuuuauacacuggcccccauggggacgggcaauggacggagacgcauccaguga

SEQ ID NO: 27889 - RNA, 1623 nt, Artificial Sequence
  derived and/or modified sequence opt5 from capsid__Norovirus__ABQ44570
augaagauggccagcaacgacgcugcccccuccaaugauggcgcggcugggcuggugccugagucuaacaaugaagccauggcccucgagccggucaugggagcuagccuggccgcucccguuaccggccagacaaacaucauugacccuuggaucagaacgaauuucgugcaagcccccaacggggaauuuaccguguccccucgcaauucucccggagagauucuugucaaccuggaacucggcccugagcugaauccguaccuugcgcaccuggcccggauguauaacggguacgcuggaggcauggaggugcagguuaugcucgccggcaaugcuuucacagccgggaaaaucauuuuugcggccgugcccccuuauuuccccgucgaaaaccugagcccuucccagaucaccauguuuccccaugugaucauugauguuagaacacuggagccggugcuccugccuaugcccgacguccggucuacccuuuuccacuuuaaucagaaggaugaaccuaaaaugcgccugguggcuaugcucuacacaccccugagaagcaacggauccggcgacgauguguucaccgucagcugccggauccuuacgcgccccucuccugaguuugacuucaccuaucugguuccgcccacaguggaguccaagaccaaaccuuuuacacuccccgugcugacccugggggaacucagcaauucuagauucccucuguccauugaugagauggucacgagccccaacgaaucuaucgugguucaaccgcagaacggacgggugacacuugacggcgagcugcucgggaccacacagcugcaggccuguaauauuugcuccauccgcggaaaggucaccggccaagugccuaacgaacagcauauguggaaucuugagguuaccaaccugaauggcacacaguuugaucccacggacgaugugccugcuccccucggggucccugacuucgccggagagguguucggcguccugagccagagaaaccgcggggaauccaaucccgccaaccgggcucacgacgcggugguugccaccuacucugauaaguauacaccgaaacugggacucgugcaaauuggcaccuggaauacaaacgacgucgagaaucagccuaccaaguuuacgcccaucgggcugaacgaaguggcuaauggacauagauucgagcaguggacacuuccccgguacagcggcgcccugacccucaacaugaaucuggccccugcuguugccccgcuuuuucccggcgaacgccuccuguucuuuagauccuacaucccucugaaagggggauucggcaaccccgcgauugauugucuggugccucaagaguggguccagcacuuuuaucaggagagcgcucccucucucggggacguggcccuggugcgguacguuaacccugauaccggaagaguccuuuucgaagccaagcugcacaaaggcggguuucucacaguguccagcaccucuacaggccccguggucgugccggcuaauggauauuuccgcuuugacagcuggguuaaccaguucuacucccuggccccuaugggcacggggaauggacggagacgcuuucaauga

SEQ ID NO: 27890 - RNA, 1653 nt, Artificial Sequence
  derived and/or modified sequence opt5 from capsid__Norovirus__ABQ44571
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccgccaucgacaugcucuauacagauccuaaugaguccauugugguccaaccccagaacggcagaugcacccuggacgggacacuucagggaaccacgcagcuggugccgacacaaaucugugcuuuucggggcacccucauuagccagacagcgcgcgccgcugauucuaccgacuccccucagagagcccgggaucacccccugcauguucaagugaagaaucuugacgggacccaguacgacccuacagaugacauccccgccguccugggagcuaucgauuucaaaggcacgguguucggcgucgccagccagcgcgacgugucugggccucaggaacaaggacacuaugcgaccagagcucacgaggcccauauugauacaaccgaccccaaguacgccccgaagcucggcacaauccugauuaaauccgaaagcaacgauuuuaucaccaaucagccuauucgguucacgcccguugggaugggagacaacaauuggagacagugggagcugcccgauuacuccggccgccucacacugaacaugaaucuugcuccugccgugucuccgagcuuucccggggagcggauccuguucuuuagauccaucgucccuagcgcuggaggcuauggcucuggguacauugacugccucaucccccaggaaugggugcaacacuucuaucaggaggccgcgccuucccagagcgccguugcucuggugcgcuacgucaaccccgauaccggacggaauauuuuugaagccaaacuucauagagagggcuuccugaccguggcuaacucugggaauaacccuaucgugguucccccgaauggauauuuucgcuucgaagccugggucaaccaguuuuacacacucgcgccuaugggcagcgggcaaggccggagacgcgcccaguga

SEQ ID NO: 27891 - RNA, 1623 nt, Artificial Sequence
  derived and/or modified sequence opt5 from capsid__Norovirus__ABQ44572
augaagauggccagcaacgacgcugcccccuccucugauggcgcggcugggcuggugccugagaucaauaacgaagucaugccgcucgaccccguugccggagccagccuggcuaccccuguggugggccagcaaaauauuaucgaucccuggauuagaaacaauuucguccaggccccugcuggggaguuuacagugucuccccggaacuccccuggagaaauccuucuggaccucgagcugggcccggaacuuaaucccuaccuggcccaccucgcgcgcauguauaacgggcaugccggaggcauggagguucagauugugcuggcuggcaaugccuucacggcugggaaaaucaucuuugccgcgauuccucccggauucccuuacgagaaccugagccccucccagaucaccaugugcccgcacgucauuaucgaugugagacaacucgaaccuguucugcuucccaugccugacauucggaauaacuuuuuccauuauaaucagggcaacgaucccaagcugcgccucguggccaugcuguacacaccccuuagagcuaauaacucuggggacgaugucuuuaccgugagcugucgggugcugacaaaaccuuccccggacuucgaguuuaccuuccucguucccccuacagucgaaagcaagaccaaacaguuuacgcugcccauccugaagauuucugagaugaccaacucccgcuucccugugcccguggaugucauguauacagccagaaaugagaaccaggugguucaaccgcagaauggacgggugacccucgacggcgaacugcuugggacaaccccucugcucgcugucaacaucugcaaguuuaaaggagaggugaucgccaagaauggcgauguucgcagcuacagaauggacauggaaauuacgaacacagacggcacccccaucgauccuacagaggacacccccgggccuauuggaucucccgauuuccagggcauccuguucgggguggccucccagcggaauaaaaacgaacaaaauccggcuacccgcgcgcacgaggccaacauuaauacaggaggcgaccaguaugcuccuaaacuugcccaggucaaguuuuucagcgagucucaagauuuugaagugcaucagcccacgaccuucacacccgucgggguggccggagacaacucccacccuuuuagacaguggacccugccgcgguacggcggccaccucacaaauaacacccaucuggcucccgccguugcgccucuguuccccggggagcagcuccuguuuuuccgcagccaaaucccuuccucuggaggccacgaaagcggguacauggauugucuugugccccaggaguggguccagcauuuuuaucaggaagcugccacggcccaauccgagguggcucugaucagauucauuaauccugacacaggacggguucucuuugaggccaagcugcacaagcagggcuucaucaccguggcucacaccggggauaaccccauugucaugccgccuaacggcuacuuuagauucgaagccugggugaaucaguucuauagccuugcgcccgugggaacaggcaacgggcgccggagaguucaguga

SEQ ID NO: 27892 - RNA, 1608 nt, Artificial Sequence
  derived and/or modified sequence opt5 from capsid__Norovirus__ABQ44573
augaagauggccagcaacgacgcugcccccuccaaugauggcgcggcugggcuggugccugaggccaacaaugaaaccauggcccucgagccggucgcuggagccucuaucgcugcgccccugacaggccagaacaauauuaucgacccuuggauuagacuuaacuucguucaagcccccaauggggaauuuacggugagcccucggaacucccccggagaggugcugcucaaucuggaacuuggcccugagcugaacccguaccucgcccaccugucucgcauguauaauggguacgcuggaggcgucgaggugcagguucugcucgccggcaacgcuuucaccgccgggaaacugguguuugcggccgugcccccucauuucccccuugaaaauaucagcccuggacagauuacaauguuuccccacgugaucaucgauguuagaacccuggagccggugcuccugccucuucccgacguccggaacaauuucuuucauuauaaccagcaaaacgaaccucgcaugagacugguggcuaugcucuacacaccccugcgguccaauggcucuggggaugacguguucaccgucagcugccgcguucugacaagacccuccccugauuuugacuucaacuaucucgugccgcccaccguggagagcaagacgaaaccuuuuacccugcccauucuuacaaucggagagcugaccaauucucgguucccuguccccauugaugaacucuacacauccccgaacgagagccuggugguucagccucagaauggccgcugugcccuugacggggaacugcagggaaccacgcaacuccugcccacagcuaucugcucuuuuagaggccggauuaaccagaagguguccggcgagaaucacgucuggaacaugcaggucaccaauaucaacgggacaccuuucgaucccaccgaagacguuccugugccccugggaaccccggauuucagcggcaaacucuuugggguccugucucagcgcgaccaugacaaugccuguagaucccacgaugccgugauugcuacaaacagcgcgaaguucacgccuaaacuuggagccauccaaaucggcaccugggaggagaaugacguccacauuaaccagcccacaaaguuuacccccguggggcuguucgaagaugagggauuuaaucaguggacacucccuaacuauuccggcgcucugacccuuaacguuggccuggccccgcccguggccccuacguuccccggggaacaaauccucuuuuuccggucucauauuccucugaagggaggcgucgcugaccccgugaucgauugccugcucccucaggaguggauucagcaccuguaccaggaaagcgcccccucccaaagcgacguugcgcuuauccgcuuuacaaauccggauaccgggagagugcuguucgaggcuaaacuccaucggucuggauacaucaccgucgccaacacaggcuccagaccuauuguggugcccgccaauggguauuuucgcuucgacagcuggguuaaccaguuuuacucucuggcuccuaugggcaccggaaauggccggagacgcguccaguga

SEQ ID NO: 27893 - RNA, 1614 nt, Artificial Sequence
  derived and/or modified sequence opt5 from capsid__Norovirus__ABQ44574
augaagauggccagcaacgacgcuacccccuccgaugacggcgccgcggggcuggugccugagaucaauaacgaagucauggcucucgagccgguugccggagccucuauugcugcccccguggugggccagcaaaauaucauugauccuuggaucagaaacaauuucguccaggcucccgccggggaauuuacagugagcccucggaacucccccggagagcugcuucuggaccucgaacugggcccugagcuuaauccguaccuggcgcaccucgcccgcauguauaacgggcaugcuggaggcauggagguucagauugugcuggccggcaaugcuuucacggccgggaaaauccuguuugcggccauucccccuucuuuccccuacgaaaaccucagcccugcucagcugaccaugugcccccacgucaucguggauguuagacaacuugagccggugcugcucccuaugcccgacauccggaaugucuuuuaucauuacaaccagaauaacuccccuaagcugcgccuuguggccaugcuguauacaccccucagagcuaauaacucuggagaugacguguucaccgucagcugucggguucugacacgccccuccccugauuuucaguucaccuuucuggugccgcccacaguggaaagcaaaaccaagaacuucacgcucccuguccugagagugucugagaugaccaauucccggguuccccgcugcuuuggcacaaaauguauucaggccagaaacgagaauaucauugugcaaccucagaacgggcggugcaccacagacggagaacuucugggcaccacgacacuccagagcgucucuaucuguaauuuccgcgggaccaugcaggccaagcugaacgagcaacccagauaccagcuucagcugacaaaucucgauggauccccgauugacccuaccgaugacaugcccgcuccucugggcacccccgacuuucaagcgaugcuguauggcguggccagccagcggucuucccgcgauaacgcuacaagagcccacgacgcccagaucgauacggcuggggacaccuucgccccuaagaucggacagguucgguucaaaagcuccucuggcgauuuugaccuccaugaucccacaaaguucaccccgauuggggugaaugucgacgaucaacacccuuuuagacaguggagccugcccaacuacggaggccaccuugcgcugaauaaccaucucgcucccgccgugacaccucuguucccgggggaacagauccuguuuuuccgcucccacauucccagcgccggaggccauaccgacggcgcuauggauugccuucucccucaggaguggaucgaacacuuuuaccaagaggccgcucccucucaguccgacauugcccugguccgguucaucaauccugacacggggagagugcugcucgaggcgaaacugcacaagcagggauuucuuacaguugccgcuagcggcgaucaucccaucgugaugccuaccaacggguauuuccgcuuugaagccugggucaaucccuucuacacccuggcuccggugggaacaggcucugggcggagacgcauucaguga

SEQ ID NO: 27894 - RNA, 1641 nt, Artificial Sequence
  derived and/or modified sequence opt5 from capsid__Norovirus__ABQ44575
augaagauggccagcaacgacgcugcccccuccaaugauggcgcggcuucucuggugccugaggggaucaacgaaaccaugccgcucgagcccgucgccggagccagcauugcugccccuguugcuggccagacaaauaucauugaccccuggaucagaacgaacuucgugcaagccccuaauggggaauuuaccgugucccccagaaacucuccuggagagauucugcuuaaucuggaacucggcccggaucugaaccccuaccuugcgcaccugagccgcauguauaauggguacgccggaggcgucgaggugcagguucuccuggcuggcaacgccuucacagcugggaaaauccuguuugccgcgaucccucccaauuucccuguggacaugauuucccccgcccagaucaccaugcucccgcaucugauugucgaugugagaacacuugagccuaucaugauuccccugccugacguucggaacguguuuuaucacuucaauaaccagccccaaccccgcaugagacucgucgcuaugcuguacaccccucuucggucuaauggaagcggcgaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucccuauugagcagcuguacaccgcccccaacgagacgaaugugguccagugucagaacgggcgcugcacacuugacggagaacugcaaggcaccacacagcuccugucuuccgcuguguguagcuauagagggcggaccguugccaauaacggagauaauugggaccagaaccuucugcagcucaccuacccuaauggcgccucuuacgaucccacagacgaggugccugcuccccugggcacgcaagacuucuccgggaugcuguauggaguccucacccaggauaacgugaauguuagcacaggcgaagcgaagaacgccaaagggaucuacauuuccaccacaucuggaaaguuuaccccgaagaucggcagcauugggcugcauuccaucacggagcacgugcauccuaaucagcaaagccgcuucacacccgucggaguggcugucaacgaaaauacccccuuccagcagugggugcuuccucacuaugccggcucucuggcccucaacaccaaucuggcuccggccguugcgcccacauuuccuggcgagcagcuucuguucuuuagaucccgggugcccugcguccaagggcuccagggacaggacgcuuucaucgauugucugcugccucaggagugggugaaccacuuuuaccaagaagccgcccccgcuccugcccccagccaggcugacguugcccucauucgcuaugugaacccggauaccggcagaacacuguucgaggcgaaacuucaucggucuggguuuaucacggucagccacaccggagccuacccucugguggugcccccuaauggccauuucagauuugacuccuggguuaaccaguucuauucucucgcucccauggggacaggcaauggacgccggcggauucaguga

SEQ ID NO: 27895 - RNA, 1623 nt, Artificial Sequence
  derived and/or modified sequence opt5 from capsid__Norovirus__ABQ44576
augaagauggccagcaacgacgcugcccccuccaaugauggcgcggcugggcuggugccugaggucaacaaugaaacccucgcccuggagccgguugccggagcuucuaucgccgcuccccuuacaggccagaacaaugugauugacccuuggaucagacugaacuucgugcaagcccccaauggggaauuuacggucagcccucggaacucccccggagagauucuccugaaucuugaacugggcccugagcucaacccguaccuggcgcaccuggcccgcauguauaauggguacgcuggaggcguggagguucaggugcuccuggccggcaacgcuuucaccgccgggaaacuugucuuugcggccauucccccucauuuccccguggauaaucugucuccuggacagaucacaauguuuccccacguuaucaucgacgugagaacccucgaaccgguccugcuuccucugcccgaugugcggaacagcuucuuucauuauaaucagcaauccgaccagcgcaugagacucauugcuaugcuguacacaccucugcggucuaacggcagcggggaugacguguucaccgucuccugccgcguucucacaagacccagccccgauuuugacuucaacuaucuggugccuccgaccguggagucuaagacgaaacccuuuuccgucccugugcuuacccugaaugaacucacaaacagccgguuccccguuccuaucgaugccauguacaccucucccaaugacuccauugugguccagccgcagaacggacgcgcuacaaucgauggcgagcugcuugggaccacgcaacugauuccuagcggaaucuguucuuuuagaggcaagauuacaacccaccucuccgacgaccggcaucuguggaauauccaggugacaaaccugaauggcacccccuucgauccuaccgacgauguucccgccccucucgggaugcccgacuucagcggacagaucuuuggcguggucucccagcgcgauacagggacgaacccggccaauagagcucacgacgcggugcuggccaccuauucugcuaaauacacaccuaaacuuggaagcguccaaauuggcaccugggauacagaggaccugcucgaacggcagcccgugaaguucacccccguugggcugaacgagaucggacaggauaagcacuuugaccaaugggugcuuccuaauuacuccggcgcccugggccucaacaugcaucuggccccggcugucagcccccuguucccuggggaacgccuccuguuuuucagaucuuauauuccccuuaagggaggccacggggauccuuuuaucgacugccuggugccccaggaguggauucagcauuucuaccaggaauccgccccugcgcaaagcucuguugcucuccugcgguaugugaaucccgacacgggaagaacacuguuugaggccaaacuucacaaggagggcuucaucaccgucagcuccaccgaaaaccgcccgguggugguuccucccaauggguacuuucgguucgauucuugggucaaccaguuuuauagccucgccccuaugggcacaggaaacggcagacgccggaugcaguga

SEQ ID NO: 27896 - RNA, 1569 nt, Artificial Sequence
  derived and/or modified sequence opt5 from capsid__Norovirus__ACJ04900
augaagaugaccgacagagauacaaucgacagcgcccccgcucugggccaggugcucccuccggaggucgaagccuccguucccguggagccuacggcgggggcucccguggccgccccuaccgcuggacaagucaaccccauugauccuuggaucuucgccaauuuugugcaggcuccgcagggcgaauuuacaauuucucccaacaauaacccuggggagauccuguuugaacuugagcugggacccgaccucaauccuuaccuggcccaccuucggcgcauguauaacggcuggaccgggagcaugagaguucgggugcugcucgcgggaaaugccuucuccgcuggcaaagucgugguuuucugcgugcccccgggcuucgauacaucuuaccugaccccuagccaggccacacaauuuccccauguccugauugacgugcgcgcuccugagcccguggaaaugccccucgaggaugucagaaacauccuguuccaccaggggccugacucccggaugcgccuuaugggaaugcuguauaccccgcucagagccaauucuggcgcggaucccuuuguugugacggggcgggugcugaccuguccuagccccaacuucuccuuuuucuuucuugucccucccacaguggaggaacgcgagaccccguucacacugccuaaucuccccguuaacagccugucucauuccagagccauggaaccuaucgcucagaugaugagcucucggaauuuccccgccuccgugcaguuucaaaacggacgcugcacccugagcggcgaccuccuggggacgacaccuucuucccccgcugaugucggaaccuucgugggccuuauugccgagccgggcagccacguuguggaacugucccagccuaaucaggaggacuuucaugccgggucugcucccgcgcccuucggauuuccugauuucagcgacuguucccucacauuugucguggccagcgcuucuaccgucggcgaaagaaccgugaacacacgguccccgcagaacuucacgcccgcccuggggcacaucaccuuugacgaggaggccccugcugaucuuuuccgcgcccaccugagaaaucucugggaccccacagaacauagcuuuuggcggauuccugauuacagagcggacguucugggaggcgaguucgcucccucugugagcgccccuggggucggagaaacccugcucuuuuucaugugcaacgugccccgcuccaauggcgccaacccgaauccuugucccugccugcuuccucaagaguggaucacacacuucguuucugaacgggcugcccugcagagcgauguggcucuccugaacuauauuaaucccaacaccggcagaguccuuuuugaguguaagcuguacgccaauggguuccucacggugaaccugggagcguccgaccaggccacacugccgguggauggcaucuuuaaauucguuagcugggucucuuuuuauuaccaacuccgcccuguggggaauauuggagugggccggagacugccccgccuugacggguucuga

SEQ ID NO: 27897 - RNA, 1569 nt, Artificial Sequence
  derived and/or modified sequence opt5 from capsid__Norovirus__ACJ04903
augaagaugaccgacagagauacaaucgacagcgcccccgcucugggccaggugcucccuccggaggucgaagccuccguucccguggagccuacggcgggggcucccguggccgccccuaccgcuggacaagucaaccccauugauccuuggaucuucgccaauuuugugcaggcuccgcagggcgaauuuacaauuucucccaacaauaacccuggggagauccuguuugaacuugagcugggacccgaccucaauccuuaccuggcccaccuucggcgcauguauaacggcuggaccgggagcaugagaguucgggugcugcucgcgggaaaugccuucuccgcuggcaaagucgugguuuucugcgugcccccgggcuucgauacaucuuaccugaccccuagccaggccacacaauuuccccauguccugauugacgugcgcgcuccugagcccguggaaaugccccucgaggaugucagaaacauccuguuccaccaggggccugacucccggaugcgccuuaugggaaugcuguauaccccgcucagagccaauucuggcgcggaucccuuuguugugacggggcgggugcugaccuguccuagccccaacuucuccuuuuucuuucuugucccucccacaguggaggaacgcgagaccccguucacacugccuaaucuccccguuaacagccugucucauuccagagugauggaaccuaucgcccagaugaugagcucucggaauuuccccgcuuccguccaguuucaaaacggacgcugcacccugagcggcgaccuccuggggacgacaccuucuucccccgccgaucuuggaaccuucgugggccugauugcugagccgggcagccacguugccgaacucucccagccuaaucaggaggacuuucaugccgggucugcucccgcgcccuucggauuuccugauuucagcgaauguucccugacauuuguggucgccagcgcuucuaccgugggcgagagaaccgucaacacacggucccuucagaacuucacgccggcccuggggcacaucaccuuugacgaggaagcccccgcugaccucuuccgcgcccaccugagaaaucugugggauccuacagagcauagcuuuuggcggauucccgacuacagagcggaugugcucggaggcgaauuugcuccuucuguuagcgcccccggggugggagagacccugcuuuucuucaugugcaacgucccucgccugaauggcgccaaccccaauccguguccuugccuccugccccaagaauggaucacacacuucguguccgagcgggcugcccuucagucugacguugcucugcucaacuauauuaauccuaacaccggcagagugcuguuugaguguaagcuguacgucaauggguuccucacggugaaccugggagccagcgaucaggcgacacuucccguggacggcaucuuuaaauucguuuccugggucagcuuuuauuaccaacugcgcccgguggggaauauuggagugggccggagacucccucgccuggauggguucuga

SEQ ID NO: 27898 - RNA, 1569 nt, Artificial Sequence
  derived and/or modified sequence opt5 from capsid__Norovirus__ACJ04906
augaagaugaccgacagagaugugacagacagcgcccccgcucugggccagguccucccuccggagguugaagccuccgugcccguggagccuacggcgggggcucccgucgccgccccuaccgcuggacaagugaaccccaucgauccuuggauuuucgccaauuuuguucaggcuccgcagggcgaguucacaaucucucccaacaauaacccuggggagauucuguuugaacuugagcugggacccgaccucaauccuuaccuggcccaccuucggcgcauguauaacggcuggaccgggagcaugagagugcggguccugcucgcgggaaaugccuucuccgcuggcaaagugguuguguuuugcgugcccccgggcuucgauacaucuuaccugaccccuagccaggccacacaauuuccccauguccugaucgacgugcgcgcuccugagcccgucgaaaugccccucgaggauguuagaaacauucuguuccaccaggggccugacucccggaugcgccuuaugggaaugcuguauaccccgcucagagccaauucuggcgcggaucccuuuguggugacggggcggguccugaccuguccuagccccaacuucuccuuuuucuuucuugugccucccacaguugaagaacgcgagccgccuuucacccugcccaaucucccugugaacaaucugagccauucuagagucauggaacccaucgcccagaugauguccagccggaacuucccugcuucugugcaguuucaaaauggacgcugcacacuguccggcgaccuccuggggaccacgcccagcucuccguccgaucuuggagccuucguuggccugaucgcugagccuggcagcagaguggucgaacucucccagcccaaccaggaggacuuucacgccgggucugcccccgcuccuuucggauuuccggauuucagcgacuguucccugacauuuguggucgcgagcgccaccacagugggcgaacggaccguuaacgcucgcucuccccagaauuucaccccugcccuugggcauauuacauuugacgaggaggcccccgcugaucuguucagagcccaccuccggaaccugugggacccuacggaacacuccuuuuggagaauccccgauuaccgcgcggacgugcugggaagcgaguucgcuccuucugucagcgcccccggcgugggggaaacccuccuguuuuucaugugcaauguuccgcggcuuaacggagccaauccuaaccccuguccuugccugcucccccaagaguggauuacacauuucguguccgaaagagcugcccugcagucugaugucgcccuucugaauuaugugaacccgaauaccggccgcgugcucuuugaggcuaagcuguacgcgaacggcuuccugacaguuaaucucggggccagcgaccaggcuacccugccugucgauggaaucuuuaaauucguguccugggugagcuuuuauuaccaacuucggcccgucggcaacgccucuguggggagacgccugccucggcucgacggauucuga

SEQ ID NO: 27899 - RNA, 1623 nt, Artificial Sequence
  derived and/or modified sequence opt5 from capsid__Norovirus__ACY00565
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucaguccggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacguggaucuggacugccugcucccucaggagugggugcagcauuucuaccaagaagcggcucccgcccagagcgauguugcccugcuucgcuuugucaauccggacaccggaagagugcuguucgaguguaaacuccacaagucuggcuaugugacagucgcucauaccgggcagcacgaucuggugaucccucccaacggcuacuuucgguucgacagcuggguuaaccaguucuauacgcuugccccuaugggaaauggcaccgggagacgccgggcucuguga

SEQ ID NO: 27900 - RNA, 1623 nt, Artificial Sequence; identical to SEQ ID NO: 27726
  derived and/or modified sequence opt5 from capsid__Norovirus__ACY00568

SEQ ID NO: 27901 - RNA, 1623 nt, Artificial Sequence
  derived and/or modified sequence opt5 from capsid__Norovirus__ACY00571
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccaaccucucucaccuggcucgcauguacaauggguaugccggaggcuucgaaguccaggugauccuugcuggcaacgccuuuacagcggggaaaauuaucuucgccgcuguuccucccaauuuuccuacggagggacugagccccucccaggugaccauguucccgcauaucauugucgacgugagacaacucgagccugugcugaucccccugccugauguccggaacaauuuuuaccacuauaaccagucuaacgacagcacaauuaagcucaucgccaugcuguacacaccccuucgcgcuaauaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcucugccuucgucgugcagccucagaacggacgguguacaaccgacggcguucuccuggggacgacacaacugucccccgugaauaucugcaccuuucgcggagaugucacacauaucgcuggcagcagaaacuauaccaugaaucucgcgucucugaacuggaauaacuacgacccuaccgaagagauucccgccccucuuggcacacccgauuucguggggaaaauccagggaguccugacgcagaccacaaagggcgacggguccacccggggacacaaggcuacaguguauaccggcagcgccccguuuacgccuaaacucggguccguucaguucucuacagacaccgaaaaugauuuugagacccaucaaaacacaaaguucacccccgugggagucauucaggacggcggcacaacgcaccgcaaugaaccccagcaaugggugcugccuagcuacuccgggagaaacguucagaaugugcaccuugccccggcugucgcccccaccuuuccuggagagcagcuccuguucuuucggagcacaaugcccggcuguucuggguacccuaacauggaucuggacugccugcucccccaggagugggugcaacauuucuaucaggaagcggcuccugcccaguccgauguggcccugcuucgcuuuguuaaccccgacaccggaagaguccuguucgaguguaaacuccacaagagcggcuacgugacaguggcucauaccgggcagcacgaucuggucaucccgccuaauggcuauuuucgguucgacucuugggugaaccaauucuacacgcuugcccccaugggaaauggcaccgggagacgccgggcucuguga

SEQ ID NO: 27902 - RNA, 1623 nt, Artificial Sequence
  derived and/or modified sequence opt5 from capsid__Norovirus__ACY00573
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagagauguucacaaugugcaucuugccccggcugucgcccccaccuuuccuggagagcagcuccuguucuuucggagcacaaugcccggcuguucuggguauccuaacauggaccuggauugccugcucccccaggagugggugcagcacuucuaccaagaagcggcuccugcccaguccgacguggcccugcuucgcuuuguuaaucccgauaccggaagaguccuguucgaguguaaacuccauaagagcggcuaugugacaguggcucacaccgggcagcacgaccuggucaucccgccuaacggcuacuuucgguucgauucuugggugaaccaguucuauacgcuugcccccaugggaaauggcaccgggagacgccgggcucuguga

SEQ ID NO: 27903 - RNA, 1623 nt, Artificial Sequence
  derived and/or modified sequence opt5 from capsid__Norovirus__ACY00576
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcacccacaauuacaccaugaaccucgcgagccugaauuggaacaauuaugacccuacagaagagauucccgccccucuuggcacgcccgauuucguggggaaaauccagggaguccugacccagacaaccaagggcgacgggucuacaagaggacauaaggcuaccguguacacgggcuccgccccguuuacaccuaaacucgggagcguucaguucuccaccgacaccgaaaacgauuuugagacacaccaaaauaccaaguucacacccgugggagucauucaggacggcucuacgacccaccggaacgaaccccagcaaugggugcugccuagcuacuccggcgggaauguucagaacgugcaucuugccccggcugucgcccccacauuuccuggagagcagcuccuguucuuucgcagcaccaugcccggcuguucuggguauccuaauauggaucuggacugccugcucccccaggagugggugcaacacuucuaccaggaagcggcuccugcccaguccgauguggcccugcuuagauuuguuaaccccgacacaggacggguccuguucgaguguaaacuccauaagagcggcuaugugaccguggcucacacggggcagcacgaucuggucaucccgccuaacggcuacucucgcuuugaccccugggugaaucaauucuauacccuugccccuaugggaaacggcacagggagacggagagcucuguga

SEQ ID NO: 27904 - RNA, 1623 nt, Artificial Sequence
  derived and/or modified sequence opt5 from capsid__Norovirus__ACY00579
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccagcacagcggggaaaauuaucuuugccgcuguuccucccaacuucccuacggagggacugucccccucucaggugaccauguuuccgcauaucauugucgacgugagacaacucgagccugugcugaucccccugccugauguccggaauaacuucuaucacuacaaucagagcaacgacuccacaauuaagcucaucgccaugcuguauacaccccuucgcgcuaacaaugccggcgaagauguuuuuaccgugagcugcagagugcugacccggcccucuccugacuucgauuuuauuuuccucgucccgcccacaguggagucccgcaccaaaccuuuuacgguucccauccugaccguggaagagaugacaaacagcagauucccuauuccccuugagaagcuguuuaccgggccgucuuccgccuucgucgugcagccucagaauggacgguguacaaccgacggcguucuccuggggacgacacaacugagccccgugaacaucugcaccuuccgcggagaugucacacauaucgcuggcacccacaauuacaccaugaaccucgcgucucugaauuggaacaauuaugacccuacagaagagauucccgccccucuuggcacgcccgauuuuguggggaaaauccagggaguccugacccagacaaccaagggcgacggguccacaagaggacauaaggcuaccguguacacgggcagcgccccguucacaccuaaacucggguccguucaguuuucuaccgacaccgaaaacgauuucgagacacaccaaaauaccaaguuuacacccgugggagucauucaggacggcagcacgacccaccggaacgaaccccagcaaugggugcugccuuccuacagcggcgggaauguucagaacgugcaucuugccccggcugucgcccccacauucccuggagagcagcugcucuuuuuccgcucuaccaugcccggcuguuccggguauccuaauauggaucuggacugccugcucccccaggagugggugcaacacuuuuaccaggaagcggcuccugcccagagcgauguggcccugcuuagauucguuaaccccgacacaggacggguccuguuugaguguaaacuccauaagucuggcuaugugaccguggcucacacggggcagcacgaucuggucaucccgccuaacggcuacuuccgcuuugacagcugggugaaucaauucuauacccuugcccccaugggaaacggcacagggagacggagagcucuguga

SEQ ID NO: 27905 - RNA, 1623 nt, Artificial Sequence
  derived and/or modified sequence opt5 from capsid__Norovirus__ACY00582
augaagauggccagcaacgacgcuaaucccuccgauggcucuguggccaaccuggucccugagguuaauaacgaagugauggcgcucgagccgguggucggggcugccaucgccgcucccguggccggacagcaaaauguuauugacccuuggaucagaaacaauuucgugcaggcucccggcggggaauuuaccgucagcccucggaacgcccccggagagauucugugguccgcgccucuuggcccggaucugaaucccuaccucucucaccuggcccgcauguauaacggguacgcuggaggcuucgaagugcagguuauccuugccggcaaugcuuuuacagccgggaaaauuaucuucgcggccgugccucccaacuuuccuacggagggacugagccccucccaggucaccauguucccgcauaugaucguggacgugagacaacucgagccuguccugauuccccugccugauguucggaauaacuuuuaucacuacaaucagucuaacgacagcacaaucaagcucauugcuaugcuguauacaccccuucgcgccgauaacgcuggcgaagacguguucaccguguccugcagaguccugacccggcccagcccugauuuugacuucaucuuucucgugccgcccacaguugagucuaaaaccaagccuuucacggugcccauucugaccgucgaagagaugacaaauucccgcuuuccuaucccccuugagaaacuguucaccgggccgagcucuacauucgugguucagccucagaacggaagauguaccacggauggcgugcuccuggggacaacccaacugucccccgucaauauuugcacauuucggggagacgugacccauaucgccggcagccgcaacuacaccaugaaucucgccucucugaacuggaauaacuaugauccuacagaagagauccccgcuccucuuggcacgcccgacuucgucgggaagauucagggagugcugacccagacaaccaagggcgacggguccacaagaggacacaaagcgaccguuuacacgggcagcgccccguuuacaccuaagcucggguccgugcaguucucuaccgauaccgaaaaugacuuugagacacaucaaaacaccaaauucacacccgucggagugauccaggauggcagcacgacccaccggaaugaaccccagcaauggguucugccuuccuacagcggccgcaacgugcacaauguccaucuugcuccggccguggcccccacauuuccuggggagcagcuccuguucuuuagaucuaccaugcccggauguuccggcuauccuaacauggaccuggauugccugcucccccaggagugggugcagcacuucuaccaagaagcugccccugcgcagagcgacguugcucugcuucgguuugucaaucccgauacagggcgcgugcuguucgaguguaagcuccauaaaucuggauaugugaccgucgcccacacgggccagcacgaccuggugauuccgccuaacggguacagcagauuugauuccuggguuaaccaguucuauacccuugcccccaugggcaauggaacaggccggagacgcgcucuguga

SEQ ID NO: 27906 - RNA, 1623 nt, Artificial Sequence
  derived and/or modified sequence opt5 from capsid__Norovirus__ACY00588
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggcuauccuugccggcaaugcguuuacagccgggaaaauuaucuucgcugccgugccucccaacuuuccuacggagggacugagccccucccagguuaccauguucccgcauaucauuguggacgucagacaacucgagccugugcugaucccccugccugaugugcggaauaacuuuuaucacuacaaucagucuaacgacagcacaauuaagcucaucgcuaugcuguauacaccccuucgcgccaacaaugccggcgaagaugucuucaccguuuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcucugcuuucgugguccagccucagaauggacgguguacaaccgacggcgugcuccuggggacgacacaacugucccccguuaacaucugcaccuuucgcggagaugugacacauaucgcgggcagcagaaauuacaccaugaaccucgccucucugaauuggaacaauuaugacccuaccgaagagauucccgcuccucuuggcacacccgauuucgucgggaaaauccagggagugcugacgcagaccacaaagggcgacggguccacccggggacacaaggccacagucuacaccggcagcgccccguuuacgccuaaacucgggucccugcaguucucuacagacaccgaaaacgauuuugagacccaucaaaauacaaaguucacccccgugggaguuauucaggacggcggcacaacgcaccgcaacgaaccccagcaaugggugcuuccuagcuacuccgggagaaaugucccgaacgugcaccuggcucccgccguugcgccuaccuuucccggagagcagcuccuguucuuucggagcacaaugccuggcuguucuggguaucccaauauggaucuggacugccuccugccucaggagugggugcagcauuucuaccaagaagcugcccccgcccaguccgaugucgcucuccugcgcuuugugaacccggacaccggaagagugcuuuucgaguguaaacugcacaagagcggcuauguuacagucgcccauaccgggcagcacgaucuugugaucccucccaacggcuacuuucgguucgacucuugggugaaucaguucuauacgcuggcuccuaugggaaacggcaccgggagacgccgggcccucuga

SEQ ID NO: 27907 - RNA, 1623 nt, Artificial Sequence
  derived and/or modified sequence opt5 from capsid__Norovirus__ACY00594
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagcccaacgacucuacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaguccugacgcagaccacaaagggcgacgggucuacccacggacauaaggccacaguguacaccggcuccgccccuuuuacgcccaaacucgggagcguucaguucuccacagacaccgaaaacgauuuugagacccaccaaaauacaaaguucacccccgugggagucauucaggacggcucuacaacgcaccggaacgaaccucagcaaugggugcugccgagcuacuccggccgcaauguucagaacgugcaucuugcccccgcugucgccccuaccuuucccggggagcagcuccuguucuuuagaagcacaaugccuggauguucuggcuaucccaauauggaucuggacugccugcucccucaggagugggugcaacacuucuaccaggaagcggcucccgcccaguccgauguggcccugcuucgguuuguuaacccggacaccgggcgcguccuguucgaguguaaacuccauaagagcggauaugugacaguggcucacaccggccagcacgaucuggucaucccucccaacggguacuuuagauucgacucuugggugaaucaauucuauacgcuugccccuaugggcaacggaaccggccggagacgcgcucuguga

SEQ ID NO: 27908 - RNA, 1623 nt, Artificial Sequence
  derived and/or modified sequence opt5 from capsid__Norovirus__ACY00597
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucggcgugagacaacucgagccugugcugaucccccugccugacguccggaauaacuuuuaucacuacaaucagucuaacgauagcacaauuaagcucaucgccaugcuguauacaccccuucgcgcuaacaaugccggggaagacguuuucaccguguccugcagagugcugacccggcccagcccugauuuugacuucauuuuucucgucccgcccacaguggagucucgcaccaaaccuuucacgguucccauccugaccguggaagagaugacaaacuccagauuuccuauuccccuugagaagcuguucaccggaccgagcucugccuucgucgugcagccucagaauggccgguguacaaccgaugggguucuccugggaacgacacaacugucccccgugaacaucugcaccuuuaaaggcgacgucacacauaucgcuggcagccgcaauuacaccaugaaccucgcgucucugaauuggaacaauuaugauccuaccgaagagauucccgccccucuugggacacccgacuucgugggaaagauccagggcguccugacgcagaccacaaagggggauggauccaccagaggccacaaagcuacaguguacaccgggagcgccccguuuacgccuaagcucggauccguucaguucucuacagacaccgaaaacgacuuugagacccaucaaaauacaaaauucacccccgugggcgucauucaggauggcgggacaacgcaccggaacgaaccccagcaaugggugcugccuagcuacuccggacgcaauguucagaacgugcaccuugccccggcugucgcccccaccuuuccuggcgagcagcuccuguucuuuagaagcacaaugcccggguguucuggauauccuaauauggaccuggauugccugcucccccaggagugggugcaacauuucuaccaggaagcggcuccugcccaguccgacguggcccugcuucgguuuguuaaccccgauaccggccgcguccuguucgaguguaagcuccacaaaagcggguaugugacaguggcucauaccggccagcacgaccuggucaucccgccuaacggauacuuuagauucgauucuugggugaaucaauucuauacgcuugcccccaugggcaacgggaccggacggagacgcgcucuguga

SEQ ID NO: 27909 - RNA, 1623 nt, Artificial Sequence
  derived and/or modified sequence opt5 from capsid__Norovirus__ACY00600
augaagauggccagcaacgacgcuaaucccuccgauggcccugccgcgaaccuggugccggaggucaauaacgaaguuauggcucucgagcccguggugggggccgccaucgcugccccugucgcuggacagcaaaaugugauugaccccuggaucagaaacaauuucguucaggccccuggcggggaauuuaccgugucuccccggaacgcgccuggagagauucuguggagcgccccgcuuggccccgaucugaauccuuaccucucccaccuggcucgcauguauaacggguacgccggaggcuucgaaguccaggugauccuugcuggcaaugccuuuacagcggggaaaauuaucuucgccgcuguucccccuaacuuucccacggagggacugucuccgagccaggugaccauguucccucauaucauugucgacgugagacaacucgagcccgugcugaucccucugcccgauguccggaauaacuuuuaucacuacaaucaguccaacgacucuacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagcaauuacaccaugaaccucgcgucucugaauuggaacaauuaugaccccaccgaagagauuccugcuccccuuggcacaccggauuucguggggaaaauccagggaguccugacgcagaccacaaagggcgacggguccaccagaggacacaaggccacaguguacaccggcagcgccccuuuuacgcccaaacucggguccguucaguucucuacagacacccaaaacgauuuugaaacccaucagaauacaaaguucacccccgugggagucauucaggacggcggcacaacgcaccggaacgagccucaacagugggugcugccgagcuacuccgggcgcaauguucagaacgugcaccuugcccccgcugucgccccuaccuuucccggagaacagcuccuguucuuuagaagcacaaugccuggcuguucuggguaucccaauauggaucuggacugccugcucccucaagagugggugcagcauuucuaccaggaggcggcucccgcccaguccgauguggcccugcuucgguuuguuaacccggacaccggacgcguccuguucgaauguaaacuccacaagagcagauaugugacaguggcucauaccggccaacacgaucuggucaucccucccaacggguacuuucgguucgacucuugggugaaucaguucuauacgcuugccccuaugggcaacggaaccggcagacgccgggcucuguga

SEQ ID NO: 27910 - RNA, 1623 nt, Artificial Sequence
  derived and/or modified sequence opt5 from capsid__Norovirus__ACY00603
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugcccugacagcggggaaaauuaucuuugccgcuguuccucccaacuucccuacggagggacucagccccucccaggugaccauguuuccgcauaucauugucgacgugagacaacuggagccugugcugaucccccucccugauguccggaauaacuucuaucacuacaaucagucuaacgacagcacaauuaagcugaucgccaugcuuuauacaccccugcgcgcuaacaaugccggcgaagauguuuuuaccguguccugcagagugcucacccggcccagcccugacuucgauuuuauuuuccuggucccgcccacaguggagucucgcaccaaaccuuuuacgguucccauccuuaccguggaagagaugacaaacuccagauucccuauuccccuggagaagcucuuuaccgggccgagcucugccuucgucgugcagccucagaauggacgguguacaaccgacggcguucugcuggggacgacacaacucucccccgugaacaucugcaccuuccgcggagaugucacacauaucgcuggcagcagaaauuacaccaugaaccuggcgucucuuaauuggaacaauuaugacccuaccgaagagauucccgccccucugggcacacccgauuuuguggggaaaauccagggagucccgacgcagaccacaaagggcgacggguccacccggggacacaaggcuacaguguacaccggcagcgccccuuucacgcccaaacucggguccguucaguuuucuacagacaccgaaaacgauuucgaggcccaucaaaauaccaaguuuacacccgugggagucauucaggacggcggcaccacacaccgcaacgaaccucagcaaugggugcugccgagcuacuccgggagaaauguucccaacgugcaccuugcuccugccgucgcgcccacguucccuggagagcagcugcucuuuuuccggagcaccaugcccggcuguucuggguauccuaauauggaucuggacugccugcucccccaggagugggugcagcauuuuuaccaagaagcugccccggcccaguccgauguggcucugcuucgcuucguuaacccugacacaggaagaguccuguuugaguguaaacuccacaagagcggcuaugugaccguggcccauacagggcagcacgaucuggucauucccccuaacggcuacuuccgguuugacucuugggugaaucaguucuauacccuugcucccaugggaaacggcacggggagacgccgggcccuguga

SEQ ID NO: 27911 - RNA, 1623 nt, Artificial Sequence
  derived and/or modified sequence opt5 from capsid__Norovirus__ACY00606
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccagaugauccuugcuggcaaugccuuuacagcggggaaaauuaucuucgccgcugugccucccaacuuuccuacggagggacugagccccucccagguuaccauguucccgcauaucauuguggacgucagacaacucgagccugugcugaucccccugccugaugugcggaauaacuuuuaucacuacaaucagucuaacgacagcacaauuaagcucaucgccaugcuguauacaccccuucgcgcuaacaaugccggcgaagaugucuucaccguuuccugcagagugcugacccggcccagcccugacuuugauuucauuuuucucgugccgcccacagucgagucucgcaccaaaccuuucacggugcccauccugaccguugaagagaugacaaacuccagauuuccuauuccccuugagaagcuguucaccgggccgagcucugccuucgugguccagccucagaauggacgguguacaaccgacggcgugcuccuggggacgacacaacugucccccguuaacaucugcaccuuucgcggagaugugacacauaucgcuggcagcagaaauuacaccaugaaccucgcgucucugaauuggaacaauuaugacccuaccgaagagauucccgccccucuuggcacacccgauuucgucgggaaaauccagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcggcacaacgcaccgcaacgaaccccagcaauggguccugccuagcuacuccgggagaaaugugccgaacguucaccuugcccccgcuguggccccuaccuuucccggagagcagcuccuguucuuucggagcacaaugccuggcuguucuggguaucccaauauggaucuggacugccugcucccucaggaguggguccagcauuucuaccaagaagcggcucccgcccaguccgauguggcccugcuucgcuuugugaacccggacaccggaagaguucuguucgaguguaaacuccacaagagcggcuaugucacaguggcucauaccgggcagcacggccuggugaucccucccaacggauacuuucgguucgauucuugggucaaucaguucuauacgcuugccccuaugggcaacgggaccggaagacgccgggcucuguga

SEQ ID NO: 27912 - RNA, 1623 nt, Artificial Sequence
  derived and/or modified sequence opt5 from capsid__Norovirus__ACY00609
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgacccgagcucugccuucgucgugcagccucagaaugggcgguguacaaccgauggaguucuccugggcacgacacaacugucccccgugaacaucugcaccuuucgcggggacgucacacauaucgcuggaagcagaaauuacaccaugaaccucgcgucucugaauuggaacaauuaugauccuaccgaagagauucccgccccucuuggcacacccgacuucgugggcaaaauccaggggguccugacgcagaccacaaagggagacggcuccacccgggggcacaaggcuacaguguacaccggaagcgccccguuuacgccuaaacucggcuccguucaguucucuacagauaccgaaaacgacuuugagacccaucaaaauacaaaguucacccccgugggggucauucaggauggaggcacaacgcaccgcaacgaaccccagcaaugggugcugccuagcuacuccggcagaaauguuccgaacgugcaccuugcccccgcugucgccccuaccuuucccggggagcagcuccuguucuuucggagcacaaugccuggauguucuggcuaucccaauauggaccuggauugcccucugccccaggagugggugcagcauuucuaccaagaagcggcuccggcccaguccgacguggcccuccugcgcuuuguuaacccugauaccgggagaguccuuuucgaguguaaacugcacaagagcggauaugugacaguggcucauaccggccagcacgaccucgucauucccccuaacggguacuuucgguucgauucuugggugaaucaguucuauacgcuggcccccaugggcaacggaaccggcagacgccgggcucuuuga

SEQ ID NO: 27913 - RNA, 1623 nt, Artificial Sequence
  derived and/or modified sequence opt5 from capsid__Norovirus__ACY00612
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucauggggaaaauccagggagugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcggcacaacgcaccgcaacgaaccccagcaauggguccugccuagcuacuccgggagaaaugugccgaacguucaccuugcccccgcuguggccccuaccuuucccggagagcagcuccuguucuuucggagcacaaugccuggcuguucuggguaucccaauauggaucuggacugccugcucccucaggaguggguccagcauuucuaccaagaagcggcucccgcccaguccgauguggcccugcuucgcuuugugaacccggacaccggaagaguucuguucgaguguaaacuccacaagagcggcuaugucacaguggcucauaccgggcagcacgaucuggugaucccucccaacggcuacuuucgguucgacucuugggucaaucaguucuauacgcuugccccuaugggaaacggcaccgggagacgccgggcucuguga

SEQ ID NO: 27914 - RNA, 1632 nt, Artificial Sequence
  derived and/or modified sequence opt5 from capsid__Norovirus__ACY00615
augaugauggccagcaaggacgcucccaccaacauggauggcacauccggggccggacagcuggugccugaggcgaauacggcugaaccgcuccccaucaaaccugucgccggcgccgcuaccgccguugcuacagccgggcaagugaacaugauugaccccuggaucaugaauaacuucgugcaggcgccucagggagaguuuaccauuucucccaauaacacaccuggcgauauccuguucgaccuucagcuggggccgcaccucaaucccuuucuggcccaucuuagcagaauguacaacggaugggucggcaauaugcaagugcggauuaugcuggcuggcaacgccuucuccgcugggaagaucaucguuugcuguauuccucccggauuuucuagccaguccaucucuauugcccaggcgaccauguucccucacgugaucgccgauguccgcgugcucgaacccauugacguuccgcuggaugacgugagaaauguccuguuucauaacaaugauaacccucagacaaugcggcuccugugcaugcuuuauacgccccugcgcagcggcgggaccuccagcggaaccgacccuuucgugaucgcuggcagagugcucacaugucccacccccgauuuuucuuuccuguuucuugucccuccggacauugagcaacggacaaaacccuucuccguuccuaauauccccaugaaccugaugagcaacucucgcguguccaugcucaucgaugggaugauggugagcaaugaccagaaccaggucccucaguuucaaaauggaagagugacccuggacggccagcugcaggauacgacaaccguuucugccgcuugcguggcccggaugcgcggcagaauuuucaacaauaacgggaauuacggagucaaccucacagaacuggacggcaaucccuaucacgccuucgauuccccggcuccucuuggguuucccgacuucggaaacugugaucugcauaugaccuuugugaagaucaauccuaacgagcucagcuccggcgaccccucugggaaaguugugauucacagcuacgaugcgaccuucgccccucaccugggaacagucaaacuugagaaugacgaugaacuggcucgguuugugggcaaggaggucgugcucgaacugacguggguuuccaaccgcgagggcgccacccugaaucucugggccgugcccaacuaugggagcucucugacacaggcuucccaacuugccccgccuaucuacccucccggauucggcgaggcgauugucuauuuuaccagcacauuccccaccgugucuaacccgaagguucccugcacgcugccucaggaauuugugagccauuucgucaaugagcaggcucccacaagaggggacgccgcccuccugcacuacguggauccugacacccaucggaaccuuggagaauuuaagauguaccccgagggcuauaugaccugugugccuaaugcugggggcggaccccaaacacugccgaucaacggcguuuucgucuuuaucuccugggugucucgcuacuaucagcucaaaccuguggggaccgccggagcugccagacggcugggccugagacgcagcuga

SEQ ID NO: 27915 - RNA, 1623 nt, Artificial Sequence
  derived and/or modified sequence opt5 from capsid__Norovirus__ACY00618
augaugauggccagcaaggacgcucccaccuccccugauggcgccucuggggcgggacagcuggugccggaggcuaacacagccgaacaaaucagcauggaccccgucgccggcgcuuccacggccguugcuaccgccggacaggugaauaugguggauccuuggauuuucaacaauuuuguccaggcgccccagggggaguucacaaucucuccuaacaauacccccggcgacauucucuuugaucugcaacuugggccucaccugaacccguuccucgcccaucugagccagauguacaauggaugggugggcaacaugagaguucggauccuucuggcuggcaaugccuuuacagcugggaaaauuaucaucugcugugugcccccuggauucgacgcccgcauucucaccaucgcgcaggccacacuguuuccccaccugauugcugaugucagaacccucgaaccuguggagcugccccuugaagacguucggaacgugcuguaucauaauuccucucagccgcaaccuacgaugcgccucgucgccaugcuguacacaccccuuagaaccggcgggggaagcggcgggaccgaugcuuucgugguggccggacggguccugacaugcccugcccccgacuuuuccuuccucuuucugguucccccuagcguggagcagaagacccgcguguucucugucccgaacaucccccugaaagaucucuccaauagcagagugccuguucccauucagggcauguuuaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguucaucccucuugaaucucccgcgccugucggauuucccgaccugggcgggugugauuggcacgugaauuucaccuuucagacccaagaccgggauccuagccaguccgucacauucgccacgaacgacgcuagcuuugugcccuaucucggaucuguuuccccgcauaauggcgagggcuuccaggccggggauaucauuggaagccugggcuggaucucugccccuagcgacaacucccaguuuaaugugugggcuauucccaaguacgggucuagccugcccgaugucacccaccucgccccugcgguguucccgcccggauuuggcgaaguuauccuguauuucuacuccacauuuccugggagcggccaacccucucagcuucaggugccuugccugcucccccaggaguucauuacccacuuuuguaacgagcaagcuccuaucgccggagaagccgcucugcuucauuaugucgaccccgauacaggccgcaaucugggggaguucaagcucuacccggacggauucaugaccugcgugccuaacuccgugagcucuggcccccagacgcugccuaucaaugggguuuuugucuucguguccugggugagcagauuuuaccagcugaaacccgucggaacagccuccgcugcccggcgccucggccugagacggauuuga

SEQ ID NO: 27916 - RNA, 1623 nt, Artificial Sequence
  derived and/or modified sequence opt5 from capsid__Norovirus__ACY00621
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucaucccucuugaaucucccgcgccugugggauuucccgaccugggcgggugugauuggcacgucaauuucaccuuucagacccaagaccgggauccuagccaguccgugacauucgccacgaacgacgcuagcuuuguccccuaucucggaucuguguccccgcauaauggcgagggcuuccaggccggggauauuaucggaagccugggcuggauuucugccccuagcgacaacucccaguuuaauguuugggcuauccccaaguacgggucuagccugcccgaugugacccaccucgccccugcggucuucccgcccggauuuggcgaagugauucuguauuucuacuccacauuuccugggagcggccaacccucucagcuucagguuccuugccugcucccccaggaguucaucacccacuuuuguaacgagcaagcuccuaucgccggagaagccgcucugcuucauuauguggaccccgauacaggccgcaaucugggggaguucaagcucuacccggacggauucaugaccugcgucccuaacuccgugagcucuggcccccagacgcugccuauuaaugggguguuuguuuucgucuccugggugagcagauuuuaccagcugaaacccgugggaacagccuccgcugcccggcgccucggccugagacggaucuga

SEQ ID NO: 27917 - RNA, 1611 nt, Artificial Sequence
  derived and/or modified sequence opt5 from capsid__Norovirus__ACY00623
augaagauggccagcaacgacgcuacccccuccgaugacggcgccgcggggcuggugccuggaaucaauucugaggucauggcucucgaaccgguugccggcgccagcauugcugcccccgugguggggcagcaaaacaucauugauccuuggaucagaaauaacuucguccaggcucccgccggagaguuuacaguguccccucgcaauucucccggcgaacugcuucuggaccucgagcuggggccugaacuuaacccguaccuggcgcaccucgcccggauguauaauggacaugcuggcggcauggagguucagauugugcuggccgggaacgcuuucacggccggagagauccuguuugcggccauucccccuagcuuccccuacgaaaaucucuccccugcucagcugaccaugugcccccacgucaucguggauguuagacaacuugagccggugcugcucccuaugcccgacauccggaacgucuuuuaucauuacaaucagaacaauucuccuaaacugcgccuuguggccaugcuguauacaccccucagagcuaacaauagcggcgaugacguguucaccgucuccugucggguucugacacgccccagcccugauuuucaguucaccuuucuggugccgcccacaguggaaucuaagaccaaaaacuucacgcucccuguccugagaguguccgagaugaccaacagccgguuucccguugugcuugaccagauguacacaucucgcaaugagaacauuaucguccaaccucagaaugggagaugcaccacagauggagaacugcucggcaccacgauucugcaguccgugagcaucuguaacuucaaggggacaaugcaggccaaacuuaaugaggaaccccgguaucaacugcagcucaccaaccuggacggaucuccgauugauccuacagacgacaugcccgccccucugggcacccccgauuuucaggcuaugcucuacggcguugcgucccaacgcagcuccaccgacaaugccacaagagcucacgaugcccagaucgacacggccggggauaccuucgcuccuaagaucggacaggugcgguucaagucuagcuccaacgacuuugaucugcaugaccccacaaaauucaccccgauuggcgucaauguggaugaccagcacccuuuucgccaauggagccuucccaacuacgggggacaccuggcccucaauaaccaucuggcgcccgcugucacaccucuuuucccgggcgagcagauccuguuuuucagaucuuauauucccuccgccgggggacacaccgauggcgccauggacugccuccugccucaggaauggguggagcauuuuuaccaggaggcugcccccagccaaucugacaucgcucugguucgguucauuaauccugauacgggcagagugcucuuugaagccaagcugcacaaacagggguuccuuacaaucgcggccagcggagaccaccccaucgucaugccuaccaacggcuauuuucgcuucgaggcuugggugaaucccuuuuacacccuggccccgguugggacaggauccggccggagacgcauucaguga

SEQ ID NO: 27918 - RNA, 1647 nt, Artificial Sequence
  derived and/or modified sequence opt5 from capsid__Norovirus__ACY00629
augaagauggccagcaucgacgcugcccccuccaacgauggcgcggcugggcuggugccugagauuaauaacgaagccauggcccucgacccggucgcuggagccgcuaucgccgcgccccugaccggccagcaaaauauuaucgauccuuggauuaugaacaauuucguucaggcccccgggggagaguuuacagugucuccuagaaacagccccggcgaagugcuucugaaucucgagcuggggccugaaaucaacccguaccuugcucaccuggcccggauguauaauggauucgcuggcggcuuugagguccaggugguucucgccgggaacgcguucacggccggaaaaaucauuuuugcugccauucccccuaauuuccccaucgacaaccuguccgcugcccagaucaccaugugcccucaugugauugucgaugugcgccaacuggagcccguuaaucucccgaugccugacgugagaaacaacuuuuuccacuacaaucagggcucugauagcaagcugcggcuugucgccaugcuguauacaccccuccgcgcuaacaauuccggggacgauguguuuaccgugucuuguagaguccugacacggccuagccccgacuucuccuuuaacuuccuuguucccccuaccguggaaagcaaaacaaagccguuuacccugcccauccucacgauuucugagauguccaauagccgcuucccugugcccaucgauucucugcauaccuccccuacagaaaacaucgucgugcagugccagaauggaagaguuacccuggacggcgagcucauggggacaacccaacugcuucccagccagauuugugcguuccggggagugcugacgcgcucuacauccagagccagcgaucaggcugacaccgccacaccgcggcucuuuaacuacuauuggcacauccagcuggacaaucuuaacggcaccccuuacgaucccgccgaggacauuccuggcccccuggggaccccugauuuccgcggaaaagucuuuggcguggcuucccaaagaaaucccgacucuacaacgcgggcccaugaagcgaagguugauaccacagcugggcgcuucaccccgaagcucggaagccuggagaucuccacagaaagcgacgauuuugaccagaaccagccuaccagauucacgcccgugggcauuggggucgaucacgaggccgacuuucaacaguggucucugcccgauuauuccggacaguucacacacaauaugaaccucgccccugcuguggccccgaauuuucccggcgaacagcugcuuuucuuucggagccaacugccuucuagcggcgggagauccaacggaauccucgacugccuggucccccaggagugggugcagcauuucuaccaggagucugcuccugcccaaacccagguugcgcuugugcgcuacgucaaucccgacaccggccgggugcuguuugaagccaaacuccacaagcugggguucaugacaaucgcuaaaaacggagauagcccuauuaccguucccccgaacggcuauuucagauuugaguccugggugaauccuuucuacacacugguccccauggggacgggcaacggacgccggagaauccaguga

SEQ ID NO: 27919 - RNA, 1614 nt, Artificial Sequence
  derived and/or modified sequence opt5 from capsid__Norovirus__ACY00632
auggccagcaacgacgcugcccccuccaaugauggcgcgaccgggcuggugccugagaucaacacagaaacgcucccgcuggagcccgucgcuggagccgccauugcugccccuguuaccggccagaauaacaucauugaccccuggaucagaaauaacuucgugcaagcuccuaauggggaauuuacagugucuccccggaacagcccuggagagauucuuaugaaucuggaacucggcccggaucugaaccccuaccuugcccaccugucccgcauguauaauggguacgcgggaggcgucgaggugcagguucuccuggccggcaacgcuuucaccgccgggaagauccuguuugcugccgugccucccaauuucccugucgacaugcucucucccgcgcagaucacaaugcugccgcaucuuauuguggauguuagaacccuggagccuaucaugauuccccucccugacgugcggaacgucuuuuaucacuucaauaaccagcccgcuccccgcaugagacugguggccaugcuuuacacaccucugcggagcaacggauccggcgaugacguguuuaccgucucuugccgcguucucacgagaccgacccccgauuucgaauuuacauaucuggugccucccagcguggaguccaaaaccaagccuuucacacugcccauccucaccauuggggaacugacgaauagccgguuuccggccccuaucgaccaacuuuacacaucucccaacgcugauauugucgugcagccucagaauggacgcuguacccuggacggcgagcuccaggggacaacccaacugcuuaccacagccaucugcuccuauagaggaaugacgagcaaccccaccucugauuacugggacgaccaucugcuccaccugguucauccuaauggcgccacauacgaucccaccgaggacgugccggcuccuuucggcacacaggauuuucgggggauccuguauggaaugcucacccagaacccccgcacguccggcgacgaagcggccaauagccacgggauuuacaucucuuccacaagcgagaaauucacccccaagcugggaaccauuggccuucaccagguccaagggagacauucccagcaccagcaaucuaaauucacaccugugggaaucgcuguuaacggcaauaccccguuucggcagugggaacugcccaacuauagcggcgcccucacacugaauacgaaccuugccccugcuguggggcccaauuucccuggagagcagauucuguuuuuccgcuccaacguccccagcgugcagggcgggcaaccuaucgaaaucgauugucucauuccccaggagugggucucucauuuuuaccaggaguccgccccgagccagucugacguggcgcugguuagauaugugaauccugauaccggacggacaaucuucgaagcuaagcugcacagacaaggcuuuauuaccaucgccgccacagggagcaaccccgucgugguuccucccaacggcuacuuccgcuuugacuccugggugaaucaguucuaugcucucgccccgaugggaaccggcaacgggcggagacgcguccaguga

SEQ ID NO: 27920 - RNA, 1617 nt, Artificial Sequence
  derived and/or modified sequence opt5 from capsid__Norovirus__ACY00635
augaagauggccagcaacgacgcugcccccuccaaugauggcgcggcugggcuggugccugagaucaacaaugaagucauggcccucgagccgguugccggaggcgcuauugccgcuccccugaccgggcagacaaacgugaucgacccuuggauuagaacgaauuucgugcaagcccccaacggagaauuuaccaucucuccucggaauagccccggcgagguccuucugaacauggaacucgggccugagcugaauccguuccuuggacaccugucccgcauguacaacggcuaugcgggcgggauugaggugcagguucucauggccggaaaugcuuuuacagccggcaaagugaucuucgcugccgugcccccucauuuucccgucgaaaaccugucuccuccccagguuaccauguucccgcacgugaucgucgaugugagaacacuggagccuauucuccugccccuuccugacgugcggaaucaguuuuuccauuacagccaagucgaugaacccaagaugcgccugguugcgaugcucuauacaccccugagauccaacgggucugccgaggacguguuuaccgugagcugccggguccuuacccgcccuuccccggauuucgaguuuaauuaccuggugcccccuacgguugaaagcagaaccaaacccuucacagugccuauccucaccauuggagagaugucuaacucccgguuucccgcuccgaucgacgucauuuauacaagcccuaacgauaaucagaacgugcagccccagaauggccgcuguacccuggacggggaacugcaaggaacgacacagcucguuccuucuggcgugugcgccuucagaggccggaucaccucccacgaggggagcgaacagaaccaguggcauaugcaacugacaaaucuuaacggaacccccuucgauccuaccgaggacauucccgcuccgcugggcacaccugauuuuaagggggagaucuucggauuuaucucucagcgcaaugcccagaacgaccccggccaaucccagcccgccaauagagcucacgacgcggucgugagcacgcgggccccuaaauucaccccgaagcucggguccgucaugauuggaacaugggugaacucugauaucgaaaaucagcccagcaaguuuaccccuguuggccugaacuccagcgagaauuucaaacagugggaacuucccgacuacucuggcgugcugacacucaacauggggcuggcuccugucgugcaccccaccuauccuggagagcaaauucuguuuuuccgcuccuacaucccccucaagggcgggcauggaaauccggccauugauugucugcuuccucaggaauggauccagcacuuuuaccaggagagcgcccccucucaaacggacguugcucugcucaacccugauacaggcagagugcuguucgaggccaaacuucaucggcagggguauaucaccauugcuaagagcggcgacggacccaucgucgugccgccuaacggcuacuuuagauucgauuccugggugaaucaguuuuauucucuggcgcccauggggaacggaaauggccgccggagaguucaguga

SEQ ID NO: 27921 - RNA, 1632 nt, Artificial Sequence
  derived and/or modified sequence opt5 from capsid__Norovirus__ACY00638
augaugauggccagcaaggacgcucccaccaacauggauggcacauccggggccggacagcuggugccugaggucucuacggcggaaccgaucagcauggagcccguugcuggcgccgccaccgcugccgcuacagccgggcaagugaauaugauugacccuuggaucauguccaacuacgugcaggcgccccagggagaguucaccauuucuccuaauaacacacccggcgauauccucuuugaccugcagcuugggccucaccugaauccguuccucagccaucuggcccaaauguauaacggaugggucggcaauaugaaagugagaguucuucuggcuggcaacgccuuuaccgcugggaagauuaucaucuccugcgugcccccuggauucgccgcgcagaaugucucuauugcccaggcuacaauguuuccccacgugaucgccgauguucgggugcucgaaccuauugaagucccccuggaggacgugcgcaacgugcuguuccauaauaacgauagcaccccgacgaugagacucaucuguaugcuguacaccccucuucgggcuuccggcucuagcuccgggacagaccccuuugucauugccggacgcguucugaccugcccuagccccgauuucaauuuucucuuccuggugcccccuaacguggagcagaaaacaaagccguuuucuguccccgaccuuccucugaaugugcucuccaacagcagaguucccucucugaucaaauccaugauggugagccaagaucacggccagaugguccaguuccagaacgggcgggugacccuggacggacaacuccagggcacgacaccuaccuccgccucucagcuguguaagauucgcggcacaguuuaucaugcuaccgggggacaaggccuuaaucugaccgaaaucgaugggacacccuaccacgcguuugagagcccggccccuaucggauuccccgaccucggcgaaugcgacuggcacauuaacgcuuccccugccaaugccuucacggaugggagcaucauucauagaaucgacgugguccaggaucccaccuuugcuccucaccugggaacaauucauuauaccaacgccaauuacgacgcgaacgugucucuuaucuguucccuggaguggcucagcccgccgucuggcggcgcucugaaggccaauccuugggccaucccccgguaugggagcacacugaccgaggcugcccagcucgcucccccuauuuacccgcccggauucggcgaagccaucgucuuuuucauguccgauuuuccuauugcgaacgggucugacggacugagcgugcccugcacgaucccucaggaguucguuacacacuuugugaaugaacaagcccccacccgcggcgaggcugcccuucugcacuacgucgauccugacacccauagaaaccucggggaguucaaacuguaucccgaaggcuuuaugacaugugugcccaauuccagcggaucuggcccucagacccuucccauuaacgggguuuucacauuuaucuccugggugagccgguucuaccagcugaagccugucggaacgaccggccccgugcgcagacucgggauccggcgcucuuga

SEQ ID NO: 27922 - RNA, 1635 nt, Artificial Sequence
  derived and/or modified sequence opt5 from capsid__Norovirus__ACY00641
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcggguccggaaucaaucugacagagcuuaacggcgaaccuuaucacgccuucgagucucccgccccgauuggguucccugaucugggaggcugcgacuggcaucucaccgcuacacccacccaggcguuuaaugacggggccaagguggucagacugagcgugacgcagggagcugccuucgccccucaccuuggcacaauccacuacaccaccacagauaccgacuauaaccccaauacauccaucauuuguacgcuggauuggcucagccagaccacaggccaaucuaacguugacccuuggcagauccccaccuacggguccacacugaccgaagcugcccagcuggcgccgccuauuuuuccucccggauucggcgagacgcucguguuuuuccugagcgauuuucccaucucuaaugggaagaacggacuuagcgucccgugcacccugccccaggaguucgugacacauuuugucaaugaacaagcuccuauucggggcgaggccgcccuccugcacuaugcugaccccgauacccaucgcaaccuuggggaguucaaacuguacccugaaggcuuuaugacaugugugcccaauaccuccggaggcgggccucagacgcuccccaucaacggaguuuucguguuugucucuugggugagcagauucuaccagcugaagccgguuggcacagccggggcugcccggcgccugggaaucagacgguccuga

SEQ ID NO: 27923 - RNA, 1635 nt, Artificial Sequence
  derived and/or modified sequence opt5 from capsid__Norovirus__ACY00645
augaugauggccagcaaggacgcucccaccaacauggauggcacauccggggccggacagcuggugccugaggcgaauacggcugaaccgaucucuauggaccccgucgccggcgccgcuaccgccguugcuacagccgggcaaauuaacaugaucgauccuuggauuaugagcaauuucgugcaggcgccccagggagaguuuaccguguccccuaacaauacacccggcgacguccucuucgaucugcagcuugggccucaacugaacccguuucucgcccaccuggcucagauguacaauggaugggugggcaacaugagaguuaaagugcuucuggccggcaaugcuuucaccgccgggaagaucauuaucucuugcauucccccuggauuuacaagccagaacaucuccaucgcgcagaugaccauguucccccaugucauugccgacgugcggguucucgaaccuaucgagauuccccuggaagaugugcgcaauguccuguuucacacgaacgacaauagaccgaccaugcggcucguguguaugcuguauacaccucuucgcgcuaacggcucuagcuccgggaccgaucccuucgugaucgccggaagaguccugacaugcccugacagcaauuuuucuuuccucuuucugguuccucccaacguggagcagaaaacccggcccuucuccgugccgaacauuccccuuaauacgcugagcaacucucgcgucccuucccucaucaagagcaugacaaucucuagagaucaaaaucagauuauccaguuucaaaacggccgggugacccuggacgggcagcugcagggaacaacccccaccuccguuagccaacucuguaaaauucgcggcacaacguaccaugcuaccggcggguccggaaucaaucugacagagcuuaacggcgaaccuuaucacgccuucgagucucccgccccgauuggguucccugaucugggaggcugcgacuggcaucucaccgcuacacccacccaggcguuuaaugacggggccaagguggucagacugagcgugacgcagggagcugccuucgccccucaccuuggcacaauccacuacaccaccacagauaccgacuauaaccccaauacauccaucauuuguacgcuggauuggcucagccagaccacaggccaaucuaacguugacccuuggcagauccccaccuacggguccgcucugacagaagccgcgcagcuggcuccgccuauuuuuccucccggauucggcgagacccucguguuuuuccugagcgauuuucccaucucuaaugggaagaacggacuuagcgucccgugcacgcugccccaggaguucgugacccauuuugucaaugaacaagccccuauucggggcgaggccgcucuccugcacuauguggaccccgauacacaucgcaaccuuggggaguucaaacuguacccugaaggcuuuaugaccuguguucccaauacauccggaggcgggccucagacccuccccaucaacggaguguucgucuuugugucuuggguuagcagauucuaccagcugaagccggugggcacggccggggcugcccggcgccugggaaucagacgguccuga

SEQ ID NO: 27924 - RNA, 1635 nt, Artificial Sequence
  derived and/or modified sequence opt5 from capsid__Norovirus__ACY00647
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgauauccucuuugaccugcagcuugggccucaccugaauccguuccucucccaucuggcccaaauguauaacggaugggugggcaauaugaaagucaaggugcuucuggccggcaacgcuuuuaccgccgggaaaauuaucaucucuugcauucccccuggauucgcggcccagaauaucagcauugcucaggccacaauguuuccccacguuaucgcugaugugagaguccucgaaccuauugaagugccccuggaggacguucggaacgugcuguuccauaauaacgauaauuccccgaccaugcgccucgucuguaugcuguacacgccucuuagagccucuggcagcuccagcgggaccgaccccuuugugaucgccggacgggugcugacaugcccuucucccgauuucuccuuucucuuccugguucccccuaacgucgagcagaagaccaaaccguuuagcgugcccaaccuuccucugaauacacucucuaacucccgcgugcccagccugauuaaugcuaugaugaucucuagagaccacggccaaaugguccaguuccagaacgggcgggugacccuggauggacagcuccaaggcacgacaccuaccucccugagccagcuuuguaagauccgcggcaagguuuuucaugcguccgggggaaauggccugaaccucacagaacuggacgggucugccuaucacgcuuucgagagccccgccccgauuggauucccugauaucggcgaaugcgacuggcacaugaaugccaccgcuaccuccaacuuuacagggagcaaugacgaguaccagauucuugugaaacaagagucuacguucgcgccccaucugggacacguccaggccgauucccucagcgcugacgccaacaccgaucugauggugucucugagcuggaucuccccuguuucugaccagcauagacgggauguggaccccugggucauuccucgcuauggcagcucccucacagaagccgcucagcuggcucccccgaucuacccucccggcuuuggggaggccaucguguucuuuaugagcgauuuccccgucgugucuggaguuaauggcaugcggauuccuuguacccuuccgcaagaauauguggcccacuuugucaacgagcaggcgcccacaagaggggaagccgcucugcuccacuacguggacccugauacccaucgcaaucugggagaguucaagauguaccccgagggcuuuaugacgugcguuccuaacuccagcgggucuggcccccagacacuuccuaucaauggagugcugaccuucgucuccugggugagcagauuuuaucagcucaaacccgugggcaccgccgggccggcucggcgccugggaauuagacgguccuga

SEQ ID NO: 27925 - RNA, 1668 nt, Artificial Sequence
  derived and/or modified sequence opt5 from capsid__Norovirus__ACY00650
augagaauggccagcuccgacgcucccgugucuggcaccgauggggccgcgggacuggucccugagagccagcaagaaguucucccgcuggagcccguggcuggcgugcagcuugccgccccugucgcugggcaguccaacaucauugaccccuggauccggaugaauuucgugcaggccccugcuggagaauuuacaguuucuccccgcgaugccccuggcgaggugcugauugaccucgaacuggggccggagcuuaaccccuaccugaaucaccucgcgagaauguauaacggauacgucggcggcauggagguggaaguugugcuggccgggaaugcuuucacggccggaaagauccuguuugcugccgucccucccagcuucccuacccauggcauuuccgcggcccaagcuacaaugcucccccacgugaucguggauguccggcagcuggagccgguucgccuuccucugcccgacgugagaaacgugauguuucauuucugccaggaaaauaaagagccucggaugcgcaucgucgccauucucuauacaccccugagagcuaacggggccggagaugacguguuuaccguuucuugucgggugcuuacccgccccagcccugauuucgacuuuaucuuccugguccucccguccguggagagcaagcugaaacaguuuacacugcccaaucuccaaccuaacgaaaugaccaauucuagauuccccacgggcauuauccagcuguacaccuccccuaacacaaaucuuguugugcaguuucagaacgggcggugccugcucgauggaacccugcuuggcacaacccccguccgcgccgcugacauuuguagcuucagaggcgugacgucuacagaggucgaugcgaccgacuccccgcggguggccgggagccaccgcaucaugguucaacugaaggaaccugacggagaggaguucucucccacaggcccuaaucccgcuccuguggggacccccgauuuucaggccgccauuuucggaacccucucccagagaaacacaggcggggcuggacaaaacagcaaucgggccagauuugcguauuucuacacgcgcaacccgaccuuugcuccuggcaucggcacagucguguucuccuuugacaccacagauuuccagaaucggcagcccaccaaauuuucucccagcgggguuuucgacgaugacuccagcgaaccuuuuaaccaguucucucugccguauuacaauggaucccugggcgccguggaugccgggaagcucgcucccccugucgcccccaacuacccuggagagcaaauccuguauuuuagaggcaauauucccuucaaagggggcuacggagaaggcgagaucgacagccuucugccucaggaauggauuacgcauuucuaugcugagcaggcccccacacagggggaugcggcccuccugcgcuacuauaacccggacaccggacgggugcuuuuugaaugcaagcugcacagagagggcuucaucaccauuaauuacacagggucuaacgcucucgccgugccuguuaauggagucuuucgcuucgagggcugggugaacaaguuuuauacccugacacccauggggaauggcaacggacggagaggccgccggagagaacuguga

SEQ ID NO: 27926 - RNA, 1617 nt, Artificial Sequence
  derived and/or modified sequence opt5 from capsid__Norovirus__ACY00656
auggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccugucucgcauguauaauggguacgccggaggcguggagguucaggugcugcucgcuggcaacgccuucaccgcugggaagcuggucuuugccgcgauucccccucauuuccccguggauaaucuuagcccuggacagaucacaauguuuccccacguuaucaucgacgugagaacccuggaaccgguccuccugccucuucccgaugugcggaacaauuucuuucauuauaaccagcaauccgaccagcgcaugagacugguggccaugcucuacacaccucugcggucuaacggcagcggggaugacgucuucaccguuuccugccgcgugcugacaagacccagccccgauuuugacuucaauuaucucgugccuccgaccgucgagucuaaaacgaagcccuuuuccgugccuguucugacccuuaacgaacugacaaauagccgguuccccgugccuauugaugcuauguacaccucucccaacgacuccaucgucgugcagccgcagaauggacgcgccacaauugauggcgagcuccuggggaccacgcaacuuaucccuagcggaauuuguucuuuuagaggcaaaaucacaacccaccuggcugacgaccggcaucucuggaacauucagguuuccaaucugaacggcacacccuucgauccuaccgacgaugugcccgccccucuggggaugcccgacuucagcggacagaucuuuggcgucgugucccagcgcgauaccgggacaaauccggccaacagagcucacgacgcgguccucgccacguauucugcuaaguacaccccuaaacugggaagcgugcaaaucggcacaugggauaccgaggaccuucuggaacggcagcccguuaaguucacacccguggggcucaaugagauuggacaggauaagcacuuugaccaauggguccugccuaacuacuccggcgcccuuggccugaauaugcaucucgccccggcugugagcccccuguucccuggggaacgccugcucuuuuucagaucuuauaucccccugaaaggaggccacggggauccuuuuauugacugccuuguuccccaggaguggauccagcauuucuaccaggaauccgccccugcgcaaagcucuguggcucugcuccgguaugucaaccccgacaccggaagaacgcuguuugaggccaagcugcacaaaggcggguucauuacagugagcuccaccgagaaucgcccggugaucguuccucccaacggcuacuuucgguucgauucuugggucaaccaguuuuauagccuugccccuaugggaaccggcaaugggagacgccggaugcaguga

SEQ ID NO: 27927 - RNA, 1623 nt, Artificial Sequence
  derived and/or modified sequence opt5 from capsid__Norovirus__ADK47170
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauauccccggcuccagaaacuacaccaugaaucucgccagccagaacuggaacuccuaugauccuaccgccgagauccccgcuccgcugggcacaccugacuucgucgggaaaauucagggagugcuuacgcagaccacacggaccaauggcucuacacgcgggcacaaggcgaccguuuacacgggaagcgccgacuuuucccccaagcugggcagagugcaauucgcuacagauaccgacaaugauuuugaaaccaaccagaauacaaaauucacccccgucggggugauccaggacggaagcacaacgccucggaacgagccgcaacaguggguucuccccucuuacuccggccgcaauauucauaacgugcaccuggccccugccgucgcucccaccuuuccuggcgaacagcuucuguucuuuagaagcacaaugcccggguguucuggauauccuaauauggaucucgacugccugcugccccaggagugggugcaauacuucuaucaggaagccgcgccggcucagagcgauguggcccuccugcgguuuguuaacccugacaccggcagaguccuuuucgaguguaagcugcacaaauccggguacgugacaguggcccauaccggacagcacgaucucgucauucccccuaacggcuauuuucgcuucgacucuugggugaaucaauucuacacgcuggcucccauggggaacggcaccggacggagacgcgcccuuuga

SEQ ID NO: 27928 - RNA, 1644 nt, Artificial Sequence
  derived and/or modified sequence opt5 from capsid__Norovirus__ADR30514
augaagauggccagcaacgacgcugcccccuccaaugauggcgcggcugaccuggugccugaggccaacaaugaagucauggcccucgagccgguugugggggcuucuaucgccgcucccguggucggacagcaaaacauuaucgauccuuggauuagagaaaauuucgugcaggcgccccagggcgaguuuaccguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacagccggcaaaaucauuuuugcugccguucccccucauuuccccguggaaaauaucuccgcggcccagaucacgaugugcccucacgucauuguggacgugagacagcuggagcccguccugcucccgcugccugauauccggaaccgcuuuuuccauuauaaucaggaaaacacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaggcauugugguccaaccgcagaaugggagaugcacccuggacggaacacuucagggcaccacgcagcuggugccuacacaaaucugugccuuucgggggacccucauuggacagacaucccgcagcucugauuccaccgacagcgcucccagacggcgcgaucacccucugcauguucagcuuaagaaccuggacggcacccaauacgaccccacagaugaggugccugcgguccucggcgccaucgacuucaaagggacgguguucggagucgcuucucagagagauguguccggccagcagguuggggccacccgggcccacgaagugcacaucaauacaaccgaccccagauauacaccgaagcugggaagcauucugaugcauuccgagucugaugacuuugucaccggccaaccugugcgcuucacgcccaucgggaugggagauaacgacuggcaccagugggagcuccccgauuacagcggccaucugacacuuaauaugucccuggcuccugccguugcgccggcuuuucccggcgaacggauucucuucuuuagaagcaucgugccuucugccgggggauacggcuccgggcagauugacugccugaucccccaggaguggguccaacacuucuaucaggaagccgcuccuagccagucugccguggcucuuauccgcuacgugaaccccgauaccggacggaauauuuuugaggccaagcugcacagagaaggcuucaucaccguugcgaacagcgggaauaacccuauugucgugcccccgaauggcuauuuucgcuucgaggccugggugaaccaguuuuacacacucaccccuaugggaacaggccaagggcggagacgcaaucaguga

SEQ ID NO: 27929 - RNA, 1623 nt, Artificial Sequence
  derived and/or modified sequence opt5 from capsid__Norovirus__ADR78255
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcucuagaaacuacaccaugaaucucgcuacccagaacuggaacuccuaugaucccacagaggaaauuccugcgccccugggcacgccggacuucguggggaaaauccagggaguccuuacccagacaacccgggccgacggcagcacacgcgggcacaaggcuaccguguacacgggauccgccgauuuuucuccuaagcugggcagaguucaauucgccacagacaccgauaaugacuuugaugcuaaucagaacaccaaauucacacccgugggggucauucaggacggaaauaccgcccaucggaacgagccccaacagugggugcucccuagcuacuccggccgcaauagccacaacguucaccuggcgccggcuguggcccccacauuuccuggcgaacagcuucuguucuuuagaucuacgaugcccggguguuccggauauccuaauauggaucucgacugccugcugccccaggaguggguccaauacuucuaucaggaagccgcuccugcccagagcgauguggcucuccugcgguuugugaaccccgacaccggcagaguucuuuucgaguguaagcugcauaaaucuggguacgucacaguggcccacaccggacagcaugaucucgugaucccgccuaacggcuauuuucgcuucgacagcugggucaaucaauucuacacacuggcgcccauggggaacggcaccggacggagacgcgcccuuuga

SEQ ID NO: 27930 - RNA, 1623 nt, Artificial Sequence
  derived and/or modified sequence opt5 from capsid__Norovirus__ADR78259
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauauccccggcuccagaaacuacaccaugaaucucgccagccagaacuggaacuccuaugauccuaccgaggaaauccccgccccgcugggcacaccugacuucgucgggaaaauucagggagugcuuacgcagaccacacggaccaauggcucuacacgcgggcacaaggcuaccguuuacacgggaagcgcggacuuuucccccaagcugggcagagugcaauucgccacagauaccgacaaugauuuugagaccaaccagaauacaaaauucacccccgucggggugauccaggacggaagcacaacgccucggaacgaaccgcaacaguggguucuccccucuuacuccggccgcaauauucauaacgugcaccuggcuccugccgucgcccccaccuuuccuggcgagcagcuucuguucuuuagaagcacaaugcccggguguucuggauauccuaauauggaucucgacugccugcugccccaggaaugggugcaauacuucuaucaggaggcugccccggcgcagagcgauguggcucuccugcgguuuguuaacccugacaccggcagaguccuuuucgaguguaagcugcacaaauccggguacgugacaguggcccauaccggacagcacgaucucgucauucccccuaacggcuauuuucgcuucgacucuugggugaaucaauucuacacgcuggcccccauggggaacggcaccggacggagacgcgcucuuuga

SEQ ID NO: 27931 - RNA, 1623 nt, Artificial Sequence
  derived and/or modified sequence opt5 from capsid__Norovirus__ADR78262
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauauccccggcuccagaaacuacaccaugaaucucgccagccagaacuggaacuccuaugauccuaccgaggaaauccccgccccgcugggcacaccugacuucgucgggaaaauucagggagugcuuacgcagaccacacggaccaauggcucuacacgcgggcacaaggcuaccguuuacacgggaagcgcggacuuuucccccaagcugggcagagugcaauucgccacagauaccgacaaugauuuugagaccaaccagaauacaaaauucacccccgucggggugauccaggacggaagcacaacgccucggaacgaaccgcaacaguggguucuccccucuuacuccggccgcaauacccauaacgugcaccuggcuccugccgucgcccccacauuuccuggcgagcagcuucuguucuuuagaagcaccaugcccggguguucuggauauccuaauauggaucucgacugccugcugccccaggaaugggugcaauacuucuaucaggaggcugccccggcgcagagcgauguggcucuccugcgguuuguuaacccugacacaggcagaguccuuuucgaguguaagcugcacaaauccggguacgugaccguggcccauacgggacagcacgaucucgucauucccccuaacggcuauuuucgcuucgacucuugggugaaucaauucuacacccuggcccccauggggaacggcacaggacggagacgcgcucuuuga

SEQ ID NO: 27932 - RNA, 1623 nt, Artificial Sequence
  derived and/or modified sequence opt5 from capsid__Norovirus__ADR78266
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccugucccgcauguauaauggguacgccggaggcuucgaaguccaggugauccuugcuggcaacgccuuuacggcugggaaaauuaucuucgccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaauucuagauuucccaucccgcuugagaagcuguucaccgggccuuccagcgcuuucgugguucagccccagaacggacgguguacaaccgauggcgugcuccuggggacgacacaacugucuccugucaauauuugcaccuuucgcggagacgugacacauaucuccggcagcagaaacuacaccaugaaucucgccucccagaacuggaacucuuaugaucccaccgaggaaaucccugcuccccugggcacaccggacuucgucgggaaaauucagggagugcuuacgcagaccacacggaccaauggcagcacacgcgggcacaaggccaccguuuacacgggauccgcggacuuuagcccuaagcugggcagagugcaauucgccacagauaccgacaaugauuuugagaccaaccagaauacaaaauucacccccgucggggugauccaggacggaucuacaacgccccggaacgaaccucaacaguggguucucccguccuacagcggccgcaauauucauaacgugcaccuggcucccgccgucgccccuaccuuucccggcgagcagcuucuguucuuuagaucuacaaugccuggguguagcggauaucccaauauggaucucgacugccugcugccucaggaaugggugcaauacuucuaucaggaggcugcccccgcgcaguccgauguggcucuccugcgguuuguuaacccggacaccggcagaguccuuuucgaguguaagcugcacaaaucuggguacgugacaguggcccauaccggacagcacgaucucgucaucccucccaacggcuauuuucgcuucgacagcugggugaaucaauucuacacgcuggccccuauggggaacggcaccggacggagacgcgcucuuuga

SEQ ID NO: 27933 - RNA, 1623 nt, Artificial Sequence; identical to SEQ ID NO: 27930
  derived and/or modified sequence opt5 from capsid__Norovirus__ADR78268

SEQ ID NO: 27934 - RNA, 1569 nt, Artificial Sequence
  derived and/or modified sequence opt5 from capsid__Norovirus__AFQ00093
augaagaugaccgacagagauaucguggacagcgcccccgcucugggccagguccucccuccggagguugaagccuccgugcccguggagccuacagcgggggcucccgucgccgccucuacggcuggacgggugaacccuauugaucccuggaucuucgccaauuuuguucaagcuccucagggcgaguucaccauuagcccgaacaauaaccccggggaaauccuguuugaacuugagcugggaccugaccucaaucccuaccuggcccaccuucgcagaauguauaacggcuggacaggguccaugcgggugcgcguccugcucgcgggaaaugccuucucugcuggcaaagugguuguguuuugcgucccucccggcuucgauaccagcuaccugacaccgucccaggccacccaguuuccucaugugcugauugacgugagagcucccgagccugucgauaugccccucgaagacguucggaacauccuguuccaccaagggcccgauucucgcaugagacuuaugggaaugcuguauacaccucuccgggccaauagcggcgcggacccguuuguggugaccgggcgcguccugacgugucccuccccuaacuucagcuuuuucuuucuugugcccccuaccguugaggaaagagagcccccguucacacugccuaaucuccccgugaacucucugucccauagccgggucauggagccuaucgcccagaugaugucuucccgcagcuuccccgcuucugugcaguuucagaauggaagaugcacccuguccggcgaucuccuggggacaaccccuagcucccccgccgaccuuggagcuuucguuggccugauugccgaaccgggcucucggguggucgagcucagccaaccuaaccaggaagauuuucacgccggguccgcucccgcgcccuucggauuuccugacuucagcgaguguucugugacguuugucguggccuccgcuacaaccguuggcgaacgcacagugaaugccagaaacccgcagaacuucacccccgcccuggggcauaucaccuuugacgaggaggcuccugccgaucuuuuccgggcgagauuucgcaaucugugggaacccacagagcacagcuucuggcggauuccugacuacagagcugauguccucggaucugacuuugcccccagcguguccgccccuggcguuggggaaacgcugcuguucuucaugugcaacgugccccgccucaauggagcuaacccgaauccuugucccugccugcuuccucaggaguggaucacccacuuugucucugaacgggccgcucugcaaagcgauguggcccuccugaacuaugugaaucccaacacaggcagaguucuuuucgaggcgaagcuguacgccaauggcuuucucaccgucaaccugggggcuuccgaccaggccauucugccgguggauggaaucuucaaauuugugagcugggucucuuucuauuaccagcuccgcccugugggcaauauuuccguugggcggagacugccccgccuugacggauuuuga

SEQ ID NO: 27935 - RNA, 1629 nt, Artificial Sequence
  derived and/or modified sequence opt5 from capsid__Norovirus__BAI52939
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccauugaaaaucucuccccucagcagaucaccauguuuccccacguuauuaucgaugugagaacacuggagccgguccuucugccucuccccgacgugcggaacaauuucuuucauuauaaccaaaaggaugacccuaaaaugcgcaucguggccaugcuguacacaccccuuagaucuaauggaagcggcgaugacgucuucaccguuuccugccgggugcugacccgccccucuccugauuuugacuucacguaucucgugccgcccaccgucgaaagcaagacaaaaccuuuuacccugcccauucugacacucggggagcuguccaacagcagauucccugccucuaucgaucagauguacaccucccccaacgaggugauuagcguucagugucagaauggacggugcacgcuugacggcgaacugcaagggacaacccagcuccaggugucuggaaucugugcuuuuaagggcgaggucacagcgcaucugcacgauaacgaccaccuuuauaauauuaccaucaccaaccugaauggcuccccguucgacccuagcgaagauauucccgccccucucgggaugcccgacuuccagggacgcguguuuggcaucaucucucaaagagaucggcacaacuccccugggcauaaugagcccgcuaaccgcggacacgacgccguugugccgacauacacggcccaguacaccccuaagcugggccagauucaaaucgggacauggcagaccgaugaccugacagucagccagcccgugaaauucacccccgucggacucaaugauacggaacauuuuaaccagugggugguuccuagauaugcuggcgcccugaaucuuaacacaaaucuggcgccguccguggcucccgucuucccuggcgagcggcuccuguuuuuccgcucuuacauuccccuuaaagggggauauggcaacccugccaucgacugccugcucccccaagagugggugcagcacuuuuaccaggaagccgcuccuagcauguccgagguugcccuggugagauguauuaaucccgauaccgggcgggcucuguucgaagccaagcuccacagagcgggauuuaugaccgucagcucuaacacauccgccccgguggugguuccugcuaacggcuauuuccgcuuugacagcugggucaaucaguucuacucucuggcccccauggggaccggcaacggacggagacgcgugcaauga

SEQ ID NO: 27936 - RNA, 1623 nt, Artificial Sequence
  derived and/or modified sequence opt5 from capsid__Norovirus__BAI52940
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugggccccagccaggugaccauguucccgcauaucauugucgacgugagacaacucgagccugugcugaucccccugccugauguccggaauaacuuuuaucacuacaaucaguccaacgacucuacaauuaagcucaucgccaugcuguauacaccccuucgcgcuaacaaugccggggaagauguuuucaccgugagcugcagagugcugacccggcccuccccugacuuugauuucauuuuucucgucccgcccacaguggagagccgcaccaaaccuuucacgguucccauccugaccguggaagagaugacaaacucuagauuuccuauuccccuugagaagcuguucaccggaccguccagcgccuucgucgugcagccucagaauggccgguguacaaccgacgggguucuccugggaacgacacaacugucucccgugaacaucugcaccuuucgcggcgaugucacaagaaucgcuggcucccggaauuacaccaugaaccucgcgagccugaauuggaacaauuaugacccuaccgaagagauucccgccccucuugggacacccgauuucgugggaaaaauccagggcguccugacgcagaccacaaagggggacggaucuacccgcggccauaaggcuacaguguacaccggguccgccccguuuacgccuaaacucggaagcguucaguucuccacagacaccgaaaacgauuuugagacccaccaaaauacaaaguucacccccgugggcgucauucaggacggcgggacaacgcauagaaacgaaccccagcaaugggugcugccuucuuacagcggacggaauguuccgaacgugcaccuugcccccgcugucgccccuaccuuucccggcgagcagcuccuguucuuucgcuccacaaugccuggguguagcggauaucccaauauggaucuggacugccugcucccucaggagugggugcagcacuucuaccaagaagcggcucccgcccagucugauguggcccugcuuagauuuguuaacccggacaccggccggguccuguucgaguguaaacuccauaaguccggguaugugacaguggcucacaccggccagcaugaucuggucaucccucccaacggauacuuuagauucgacagcugggugaaucaguucuauacgcuugccccuaugggcaacgggaccggacgccggagagcucuguga

SEQ ID NO: 27937 - RNA, 1623 nt, Artificial Sequence
  derived and/or modified sequence opt5 from capsid__Norovirus__BAQ20801
augaagauggccagcuccgacgcuaaccccucugauggcagcgccgcgaaucuggugccugaggucaacaaugaagacauggcucucgagccgguugugggggccgccaucgcugcccccguggcuggacagcaaaacgucauugauccuuggaucagaaauaacuucgugcaggcccccggcggggaauuuaccguuuccccucggaaugcgcccggagagauucuguggucugccccucuuggcccggaccugaaccccuaccucagccaccuggcucgcauguauaauggguacgccggaggcuucgaagugcaggucauccuugcuggcaacgccuuuacagcggggaaagugauuuucgccgcuguuccucccaauuuuccuacggagggacugucccccucucaggugaccauguucccgcauaucgucguggaugugagacaacucgagccuguccugaucccccugccugacguucggaacaauuuuuaucacuacaaccagagcaaugaucccacaauuaagcucaucgccaugcuguauacaccccuucgcgcuaacaacgccggcgacgauguguucaccguguccugcagaguccugacccggccuagcccggacuuugauuucauuuuucucgugcccccuacaguugaaucucgcaccaaacccuucuccgugccuguccugacgguggaggaaaugaccaauagcagauuucccaucccgcuugagaagcuguucacagggccuucuuccgccuucguugugcagccccagaacggacgguguaccacagacggcguccuccuggggaccacgcaacugagcccugugaauauuugcacauuucgcggagaugucacccauaucacaggcucuagaaacuacaccaugaaucucgcuucccagaacuggaauaacuaugaccccaccgaggaaauuccugcgccccugggcacaccggacuucguggggaaaauccagggaguucuuacgcagaccacacggaccgauggcagcacacgcgggcacaaggccaccguguacacgggauccgcuaauuuuucuccuaagcugggcagaguccaauucgagacagacaccgaucaugacuuugaagugaaccagaauaccaaauucacacccguuggggugauccaggauggaggcaccacacaccggaacgagccccaacaguggguccucccuagcuacuccggccgcaauacgccgaacgugcaccuggcccccgccguggcuccuaccuuucccggggaacagcuucuguucuuuagaagcacaaugccuggauguucuggcuaucccaauauggaccucgauugccugcugccucaggaguggguucaauacuucuaucaggaggccgcgcccgcucaguccgacgucgcccuccugcgguuugugaacccggauaccgggagagugcuuuucgaauguaagcugcauaaaagcggauacgucacaguggcccacaccggccagcaugaccucguuauuccucccaacggguauuuucgcuucgauucuugggugaaucaauucuacacgcuggcuccuaugggcaacggaaccggccggagacgcgcccuuuga

SEQ ID NO: 27938 - RNA, 1623 nt, Artificial Sequence
  derived and/or modified sequence opt5 from capsid__Norovirus__BAQ20803
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcuaauuuuucuccuaagcugggcagagugcaauucgagacagauaccgaccaugauuuugaaguuaaccagaauaccaaauucacacccgugggggucauccaggacggaagcaccacacaccggaacgagccccaacagugggugcucccuuccuacagcggccgcaauacgccgaacgugcaccuggcccccgccguugcuccuaccuuucccggcgaacagcuucuguucuuuagaucuacaaugccuggguguuccggauaucccaauauggaucucgacugccugcugccucaggaguggguccaauacuucuaucaggaggccgcgcccgcucagagcgauguggcccuccugcgguuugugaacccggacaccggcagaguccuuuucgaauguaagcugcauaaaucuggguacgugacaguugcccacaccggacagcaugaucucgugauuccucccaacggcuauuuucgcuucgacagcugggucaaucaauucuacacgcuggcuccuauggggaacggcaccggacggagacgcgcccuuuga

SEQ ID NO: 27939 - RNA, 1623 nt, Artificial Sequence
  derived and/or modified sequence opt5 from capsid__Norovirus__BAQ20805
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaggggaaucucgcaccaaacccuucuccgugccuguccugacgguggaggaaaugaccaauagcagauuucccaucccgcuugagaagcuguucacaggaccuucuuccgccuucguugugcagccccagaacggccgguguaccacagaugggguccuccugggaaccacgcaacugagcccugugaauauuugcacauuucgcggcgacgucacccauacaaccggcucucacaacuacaccaugaaucucgcuucccagaacuggaauaacuaugaucccacagaggaaaucccugcgccccuggggacgccggacuucgugggaaaaauucagggcaugcuuacccagacaaccagaacagacgggagcacccggggacauaaggccacgguuuacacaggcuccgcugauuuugccccuaagcuggggcgcgugcaauucggaaccgacaccgaucacgaccucgaggccaaucagaacacaaaauuuacccccgucggcgugauccaggauggcucuacaacgcacagaaaugaaccccaacaguggguucugccuagcuacuccgggcggaacaccccgaaugugcaucuugcucccgccgucgcgccuacauuccccggagagcagcugcucuuuuuccgcagcaccaugccuggcuguucuggguaucccaacauggaccuggauugccugcucccucaggaaugggugcaauacuuuuaucaggaggcugcccccgcccaguccgacguggcucugcuuagauucguuaauccggauacaggacggguccuguuugaguguaagcuccacaaaagcggcuacgugaccguggcccauacggggcagcacgaccuggucaucccucccaacggcuauuucagauuugauucuugggugaaccaauucuacacccuugcuccuaugggaaauggcacagggcgccggagagcccuguga

SEQ ID NO: 27940 - RNA, 1647 nt, Artificial Sequence
  derived and/or modified sequence opt5 from capsid_protein__Norovirus__AAB06271
augaagauggccagcaacagagcugcccccuccaaugacggcgcggcuugccuggugccugagaucaacaaugaagccauggcccucgagccggucgcuggggccgcuauugccgcgccccugaccggacagcaaaacaucauugauccuuggaucaugaauaacuucguucaggcccccggcggggaauuuacagugucuccucggaauagccccggagaggugcuucugaaccucgaacugggcccugagauuaauccguaccuugcucaccuggcccgcauguauaacggguacgcuggaggcuucgagguccaggugguucucgccggcaaugcguuuacggccgcuaaaaucaucuucgccgcuauucccccuaacuuucccaucgacaaucuguccgccgcccagauuaccauguguccucaugugaucgucgaugugagacaacuggaacccauuaaccucccgaugccugacguucggaauaacuucuuucacuauaaccaggggucugauagccgccugagacuuaucgcuaugcuguacacaccccuccgggcgaauaacuccggagacgauguguucaccgucucuugccgcgugcugacaagaccuagccccgacuuucuuuucaauuuucuggugcccccuaccgucgaguccaagacaaaaccguucacccuccccauucugacgaucagcgaaaugucuaacucccgguuuccuguucccaucgauagccugcauaccucuccuacagagaauauuguggugcagugucagaacggccgcgucacccucgacggggagcugaugggaacaacccaacuucugcccucccagaucugcgccuucagaggcacgcucacagggagcaccucucgggcuuccgaucaggccgacacaccgaccccucgccuguucaaucaccauuggcacauucagcuugauaaccugaauggaacccccuaugacccugccgaagacauccccgcuccucucggcacacccgauuuuagaggcaagguguucgggguugccggacaacggaacccggacagcacgacccgcgcgcacgaggcuaaaguggauacaaccuccggcagauuuacaccuaagcuggggucucuggaaauuaccacggagagcgacgaucucgaccugucccagcccacaaaguucacccccgucggaaucggcguggauaaucgggccgaauuucagcaauggagccuuccugacuacucugggcaguucacccauaacaugaaucuggccccggcuguugcccccaacuuuccuggagagcagcuccuguucuuuagaucccagcuucccagcucuggcggccgcagcaauggggugcuggauugucucgucccucaagagugggugcagcacuucuaucaggaauccgcucccgcccagacacaagucgcgcuggugcgguacguuaacccugacaccggaagagugcuguuugaggccaaacuccauaagcugggcuucaugacagucgcuaaaaacggggauucucccaucacggugccgccuaauggauacuuucgcuucgaaagcuggguuaaccccuucuauacccuugccccuaugggcacagggaauggccggagacgcauucaguga

SEQ ID NO: 27941 - RNA, 1620 nt, Artificial Sequence
  derived and/or modified sequence opt5 from capsid_protein__Norovirus__AAK96218
augaagauggccagcuccgacgcuaaccccucugauggcagcaccgccaaucuggugccugaggucaacaaugaaguuauggcgcucgagccgguggugggggcugccaucgccggacccgucgcuggccagcaaaacgugauugacccuuggaucagaaauaacuucguucaggcccccgggggagaauuuacaguguccccuacgaaugcucccggcgagauucuguggucugccccucuugggccggaucugaaccccuaccucagccaccuggcgcggauguauaauggauacgccggcggcuucgaaguccaggugauccuugcugggaacgccuuuaccgcuggaaaaauuaucuucgccgcgguuccucccaauuuuccuacagagggccugucccccucucaggugaccauguucccgcauaucauugucgacgugcgccaacucgagccugugcugaucccccugccugaugccagaaacaauuuuuaucacuacaaccagagcaaugacuccacaauuaagcucaucgcuaugcuguauacaccccuucgggccaacaacgcuggggaugacgucuucaccguuagcugccgcgugcugaccagacccucuccugauuuugacuucauuuuucucgugccgcccacggucgaaucccggaccaaaccuuucacagugcccauccugaccguugaggaaaugagcaauucucgcuuuccuauuccccuugagaagcuguacacaggaccguccagcguguucgucgugcagccucagaacggcagauguaccacggaugggguucuccugggaacaacccaacugucugccgugaauaucugcacauuccggggcgacgucacccauaucgccggcucccacgauuauaccaugaaccucgcuagccagaauuggaacaauuacgaccccacagaggaaauuccugcgccccuggggacgccugacuuugugggaaaaauccagggcaugcuuacccagacaacccgcgaggauggguccacaagagccaccaaggcuacggucucuacaggaagcgugcauuucacccccaagcugggcuccguucaauacaccgccgacacaaacaaugauuuucagaccgggcagaacacaaaauucacgccggugggagucauucaagacggcagcaaucaccagaacgaaccucagcagugggugcucaccaauuauucuggccggacagggcacaacguucaucuggcccccgcuguggcccccaccuuuccuggagagcaacuucuguucuuucgcuccacaaugccgggcuguagcggguaccccaauaugaaccucgauugccugcugccucaggaauggguccagcacuucuaucaggaggcggcucccgcccaaucugacguggcccuccugagauuugugaacccugauaccggacggguucuuuucgaguguaagcugcauaaaagcggcuacgucacgguggcucacaccgggccccacgaccucgugaucccucccaauggcuauuuucgcuucgauccgugggucaaccaguuuuacacacuggccccuaugggaaauggcgcugggagacggagagcccuuuga

SEQ ID NO: 27942 - RNA, 1623 nt, Artificial Sequence
  derived and/or modified sequence opt5 from capsid_protein__Norovirus__AAR97648
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugguccaggaugggaacggaacccaccaaaaugagccccagcagugggugcucccuuccuacagcggcagaacagggcauaacguucaccuggcuccggccguggcccccaccuuuccuggagaacagcuucuguucuuucgguccacaaugcccggcuguucuggguacccuaacaugaaucucgacugccugcugccccaagaguggguccagcauuucuaucaggaggcugccccugcgcagagcgauguggcucuccugcgcuuugugaaccccgacaccggcagaguucuuuucgaauguaaacugcacaaguccggauacgucacgguggcccacaccggccaacaugaucucgugaucccgccuaauggguauuuucgguucgacagcugggucaaccaguucuacacacuggcccccaugggaaauggcaccgggagacgccgggcucuuuga

SEQ ID NO: 27943 - RNA, 1623 nt, Artificial Sequence
  derived and/or modified sequence opt5 from capsid_protein__Norovirus__AAR97651
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuguuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgaccccaccaucaagcucauugcuaugcuguauacaccccuucgcgccaacaaugcuggcgaagauguguucaccgugagcugcagaguccugacacggccuuccccggacuuugauuucaucuuucucgugcccccuaccguugagagccgcacgaaacccuucaccgugccuauucugacagucgaagagaugaccaacucuagauuucccaucccgcuugagaagcuguucacagggccuuccagcgccuucgugguucagccccagaauggacgguguaccacggacggcgugcuccuggggacaacccaacugucuccugucaacauuugcacauuucgcggagaugugacccauaucgccggcacccacaauuacacaaugaaccucgcuucccagaauuggaacaauuaugaccccacggaagagaucccugcgccccugggcaccccggauuucgucgggcggauucagggaaugcuuacacagaccacaagaggcgacgggagcacccgcggacauaaagccacggugucuacaggcgacguucacuuuaccccuaagcugggguccauccaauucaacaccgauacaaauaacgacuuugaaaccggacagaauacaaaguucacgcccgugggcgucgugcaggauggcaacgggacccaccaaaaugagccccagcaguggguucucccuagcuacuccggaagaacaggccauaacgugcaccuggcuccggccgucgcccccaccuuuccuggggaacagcuucuguucuuucggucuacaaugcccggauguagcggcuacccuaacaugaaucucgacugccugcugccccaagagugggugcagcauuucuaucaggaggcugccccugcgcaguccgauguggcucuccugcgcuuuguuaaccccgacaccgggagaguccuuuucgaauguaaacugcacaagagcggcuacgugacgguggcccacaccggacaacaugaucucgucauuccgccuaauggcuauuuucgguucgacucuugggugaaccaguucuacacacuggcccccauggggaauggaaccggcagacgccgggcucuuuga

SEQ ID NO: 27944 - RNA, 1623 nt, Artificial Sequence; identical to SEQ ID NO: 27942
  derived and/or modified sequence opt5 from capsid_protein__Norovirus__AAR97654

SEQ ID NO: 27945 - RNA, 1623 nt, Artificial Sequence; identical to SEQ ID NO: 27942
  derived and/or modified sequence opt5 from capsid_protein__Norovirus__AAR97657

SEQ ID NO: 27946 - RNA, 1623 nt, Artificial Sequence; identical to SEQ ID NO: 27942
  derived and/or modified sequence opt5 from capsid_protein__Norovirus__AAR97660

SEQ ID NO: 27947 - RNA, 1623 nt, Artificial Sequence
  derived and/or modified sequence opt5 from capsid_protein__Norovirus__AAR97663
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagcucaacgaccccaccauuaagcugaucgcuaugcuuuauacaccccugcgcgccaacaaugcuggcgaagauguuuucaccgugucuugcagagugcucacacggccuagcccggacuuugauuucauuuuucuggugcccccuaccgucgagucccgcacgaaacccuucaccguuccuauccuuacaguggaagagaugaccaacagcagauuucccauuccgcuggagaagcuguucacagggccuucuggagccuucgucgugcagccccagaauggccgguguaccacggacgggguucugcugggaacaacccaacucuccccugugaacaucugcacauuucgcggcgaugucacccauaucgccggcacccacaauuacacaaugaaccuggcuagccagaauuggaacaauuaugaccccacggaagagauuccugcgccccuugggaccccggauuucgugggaagaauccagggcaugcugacacagaccacacgcggggacggaucuacccggggccauaaagccacggucuccacaggggacgugcacuuuaccccuaagcucggaagcauucaauucaacaccgauacaaauaacgacuuugaaaccggccagaauacaaaguucacgcccguuggcgugguccaggaugggaacggaacccaccaaaaugagccccagcagugggugcugccuucuuacuccggcagaacagggcauaacguucaccuugcuccggccguggcccccaccuuuccuggagaacagcuccucuucuuucggagcacaaugcccggcuguuccggguacccuaacaugaaucuggacugccugcucccccaagaguggguccagcauuucuaucaggaggcugccccugcgcagucugauguggcucugcuucgcuuugugaaccccgacaccggcagaguucuguucgaauguaaacuccacaagagcggauacgucacgguggcccacaccggccaacaugaucuggugaucccgccuaauggguauuuucgguucgacuccugggucaaccaguucuacacacuugcccccaugggaaauggcaccgggagacgccgggcucuguga

SEQ ID NO: 27948 - RNA, 1623 nt, Artificial Sequence
  derived and/or modified sequence opt5 from capsid_protein__Norovirus__AAS86774
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccuggcccgcauguauaauggguacgcuggaggcguggagguucaggugcugcucgccggcaacgcuuucaccgccgggaaacuggucuuugcggccauucccccucauuuccccguggauaaucuuucuccuggacagaucacaauguuuccccacguuaucaucgacgugagaacccuggaaccgguccuccugccucuucccgaugugcggaacaauuucuuucauuauaaccagcaaagcgaccagcgcaugagacugguggcuaugcucuacacaccucugcgguccaacggcucuggggaugacgucuucaccguuagcugccgcgugcugacaagacccucccccgauuuugacuucaauuaucucgugccuccgaccgucgagagcaagacgaaacccuuuucugugccuguucugacccuuaacgaacugacaaauucccgguuccccgugccugucgaugccauguacaccagccccaacgacucuauugugguucagccgcagaauggacgcgcuacaaucgauggcgagcuccuggggaccacgcaacuuauuccuuccggaaucuguagcuuuagaggcaagauuacaacccaccugucugacgaccggcaucucuggaacauccagguguccaaucugaacggcacacccuucgauccuaccgacgauguccccgccccucuggggaugcccgacuucagcggacagauuuuuggcguggucucccagcgcgauaccgggacaaauccggccaacagagcucacgacgcggugcucgccacguauucugcuaaauacaccccuaagcugggaagcguucaaaucggcacaugggauaccgacgaucuucuggagcggcagcccgugaaguucacacccgucgggcucaaugaaaucggacaggacaaacacuuugaucaaugggugcugccuaacuacuccggcgcccuuggccugaauaugcaucucgccccggcuguuagcccccuguucccuggggagcgccugcucuuuuucagaucuuauauuccccugaagggaggccacggggacccuuuuaucgacugccuugugccccaggaauggauucagcauuucuaccaggaguccgccccugcgcaaagcucugucgcucugcuccgguaugugaaccccgauaccggaagaacgcuguuugaagccaaacugcacaaggagggcuucaucacagugagcuccaccgagaaucgcccgguuauugucccucccaacggguacuuucgguucgacucuugggugaaccaguuuuauagccuugccccuaugggcaccggaaauggcagacgccggaugcaguga

SEQ ID NO: 27949 - RNA, 1623 nt, Artificial Sequence
  derived and/or modified sequence opt5 from capsid_protein__Norovirus__AAS86777
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccuggcccgcauguauaauggguacgcuggaggcguugaggugcagguccugcucgccggcaacgcuuucaccgccgggaaacugguguuugcggccauucccccucauuuccccguugauaaucuuucuccuggacagaucacaauguuuccccacgugauuaucgacgucagaacccuggaaccggugcuccugccucuucccgaugugcggaacaauuucuuucauuauaaccagcaaagcgaccagcgcaugagacuggucgcuaugcucuacacaccucugcgguccaacggcucuggggaugacguuuucaccgugagcugccgcgugcugacaagacccucccccgauuuugacuucaauuaucucgucccuccgaccguggagagcaagacgaaacccuuuucuguuccugugcugacccuuaacgaacugacaaauucccgguuccccgucccuaucgaugccauguacaccagccccaacgacucuauugugguucagccgcagaauggacgcgcuacaaucgauggcgagcuccuggggaccacgcaacuuauuccuuccggaaucuguagcuuuagaggcaagauuacaacccaccugucugacgaccggcaucucuggaacauccagguguccaaucugaacggcacacccuucgauccuaccgacgauguccccgccccucuggggaugcccgacuucagcggacagauuuuuggcguggucucccagcgcgauaccgggacaaauccggccaacagagcucacgacgcggugcucgccacguauucugcuaaauacaccccuaagcugggaagcguucaaaucggcacaugggauaccgaggaccuucuggaacggcagcccgugaaguucacacccgucgggcucaaugagaucggacaggauaaacacuuugaccaaugggugcugccuaacuacuccggcgcccuuggccugaauaugcaucucgccccggcuguuagcccccuguucccuggggaacgccugcucuuuuucagaucuuauauuccccugaagggaggcuacggggauccuuuuaucgacugccuugugccccaggaguggauucagcacuucuaucaggaauccgccccugcgcaaagcucugucgcucugcuccgguacgugaaccccgacaccggaagaacgcuguuugaggccaaacugcauaaggagggcuucaucacagugagcuccaccgaaaaucgcccgguuauugucccucccaacggguauuuucgguucgauucuugggugaaccaguuuuacagccuugccccuaugggcaccggaaauggcagacgccggaugcaguga

SEQ ID NO: 27950 - RNA, 1623 nt, Artificial Sequence
  derived and/or modified sequence opt5 from capsid_protein__Norovirus__AAS86780
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccauccagggcauguuuaugucuccugacguuaaccaguccgugcaauuccagaauggccggugucagauugaugggcaacugcagggaacgacacccgucagccuuucucagcugugcaagauccgcggcaaaaccuccagcaacgcuagagugcucaaccuguccgagguugacgggacaccguucgugccucuugaaucucccgcgccugucggauuucccgaccugggcgggugugauuggcacgugaauuucaccuuucaggcccaaaaccaggacccuagccaguccgucaccuucgcuacaaaugaugccagcuuugugcccuaucucggaucuaucuccccgcauaacggcggcgacuuccacgccggggauauuaucggaagccugggcuggauuucugcuccuagcgacaauacgcagcugaacguuuggaccauccccaaguacggguccucucuccccgaugugacacaccuggccccugcggucuuuccgcccggauucggcgaggugauucuuuauuuuuacagcaccuucccuggguccggccaacccagccagcugcagguuccuugccuccugccccaggaauuuaucacacauuucuguaaugagcaagcuccuaucgccggagaggccgcccuucugcacuauguggaccccgauaccggccggaaccucggggaauuuaagcuguacccggacggauucaugacgugcgucccuaauucuguguccagcggcccccagacacugccuauuaacgggguguucguuuuugucucuugggugucccgcuucuaccagcucaaacccgugggaaccgcuagcgcugccagacggcugggccuucgcagaaucuga

SEQ ID NO: 27951 - RNA, 1623 nt, Artificial Sequence
  derived and/or modified sequence opt5 from capsid_protein__Norovirus__AAS86783
augaugauggccagcaaggacgcucccaccuccccugauggcgccucuggggcgggacagcuggugccggaagcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguuccauaauuccucucagccgcaaccuacgaugcgccucguggccaugcuguauacaccccuuagaaccggcgggggaagcggcgggaccgaugcuuuugucguggccggacgggugcugacaugcccugcccccgacuucuccuuucucuuccuggugcccccuagcguugagcagaagacccgcguguuuucugugccgaacgucccccugaaagaucucuccaauagcagagugccuguucccauucagggcauguucaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggucuccguuuaucccucuugaaagccccgcgccugucggauuccccgaccugggcgggugugauuggcacgugaauuuuacauuccaggcccaagaccaggauccuucccagagcgucaccuuugcuaccaacgacgccucuuucgugcccuaccucggauccaucagcccgcauaauggcggcgauuuucacucuggggacauuaucggaagccugggcuggauuuccgccccuucugauagcucccagcugaacguuuggacaauccccaaguaugggagcucucuccccgacgugacgcaccuggcuccugccgucuucccgcccggauuuggcgaggugauucuuuacuucuauuccaccuuuccugggagcggccaacccguucagcuccaggugccuugccugcugccccaggaguucaucacacauuuuuguaaugaacaagcgccuaucgcuggagaggccgcccuucugcacuacgucgaucccgacaccggccggaaccucggggaguucaagcuguauccggauggauucaugacaugcgugccuaauucuguguccagcggcccccagacccugccuauuaacgggguuuuugucuucguguccugggugucucgcuuuuaccagcucaaacccgucggaacggcuagcguggccagacggcugggccuucgcagaaucuga

SEQ ID NO: 27952 - RNA, 1623 nt, Artificial Sequence
  derived and/or modified sequence opt5 from capsid_protein__Norovirus__AAS86786
augaagauggccagcaacgacgcugcccccuccaaugauggcgcgaccgggcuggugccugagaucaacaaugaaacacucccgcuggagcccgucgcuggagccgccauugcugccccuguuacgggccagaacaauaucauugaccccuggaucagaaccaacuucgugcaagcuccuaauggggaauuuacagugucuccccggaacagcccuggagagauucuucugaaucucgaacugggcccggaucuuaaccccuaccuggcccaccucucccgcauguauaauggguacgcgggaggcgucgaggugcagguucugcuggccggcaacgcuuucaccgccgggaaaauccucuuugcugccgugccucccaauuucccugucgaguuucugucucccgcgcagaucacaaugcuuccgcaucugauuguggacguuagaacccucgaaccuaucaugauuccccugccugaugugcggaacacauucuuucacuauaauaaccagcccgccaaccgcaugagacuugucgcuaugcuguacacgccccuccggagcaauggauccggcgacgauguguucaccgugucuugccgcguccugaccagaccuacaccggacuuugaguucaccuaucugguucccccuagcguggaauccaagacaaaacccuuuagccucccuauccugaccauuucugagcuuacgaacucccgguuccccgccccgaucgauagccuguuuacagcucaaaauaacaaucucaacgugcagugucagaaugggcgcugcacccuggacggagagcuucagggcacaacccaacugcucccuucugggauuugugccuucagaggacggcugaccgccgaugucgacggcucccaugaugaccgcuggcacaugcagcugacaaaccucaauggcacgcccuucgacccuaccgaagaugugcccgcuccucuggggacacccgacuuuaccggacuucuguucggcguugcgagccagagaaacguggggucuaauccgaacacaacccgggcccaugaggcugucguguccacgacaagcucccaguuuguuccuaagcucggaucugugaauuucggcagcaccuccaccgauuuucaacugcagcagcccacaaaauucacccccgucgggaucaagaucgaaagcggacacgaguuugaccaaugggcccuuccucgcuacucuggccaccugacacucaacaugaaucuggccccgcccauugcuccuaacuuccccggcgaacagcugcucuuuuucagauccaacgugccuugcgccgggggagucagcgauggcgugaucgacugucugcuuccccaggaguggauucagcauuuuuaucaagagucugcgccuagccaguccgauguugcucugauccgguacgugaaucccgacacggggagaacccucuucgaagccaagcugcaccgcacaggauacauuaccgucgcccauucuggcgauuauccgcuggugguuccuagcaacggguacuuucgguucgacuccugggugaaucaguucuauagccuugcucccaugggcacaggaaacggcagacgccggguccaguga

SEQ ID NO: 27953 - RNA, 1623 nt, Artificial Sequence
  derived and/or modified sequence opt5 from capsid_protein__Norovirus__AAS86792
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccuggcccgcauguauaauggguacgcuggaggcguggagguucaggugcugcucgccggcaacgcuuucaccgccgggaaacuggucuuugcggccauucccccucauuuccccguggauaaucuuucuccuggacagaucacaauguuuccccacguuaucaucgacgugagaacccuggaaccgguccuccugccucuucccgaugugcggaacaauuucuuucauuauaaccagcaaagcgaccagcgcaugagacugauugcuaugcucuacacaccucugcgguccaacggcucuggggaugacguguucaccgucagcugccgcguucugacaagacccucccccgauuuugacuucaauuaucucgugccuccgaccguggagagcaagacgaaacccuuuucugucccugugcugacccuuaacgaacugacaaauucccgguuccccguuccuaucgaugccauguacaccagccccaacgacucuauugugguccagccgcagaauggacgcgcuacaaucgauggcgagcuccuggggaccacgcaacuuauuccuuccggaaucuguagcuuuagaggcaagauuacaacccaccugucugacgaccggcaucucuggaacgugcagguuuccaaucugaacggcacacccuucgauccuaccgacgaugugcccgccccucuggggaugcccgacuucagcggacagaucuuuggcgucgugucccagcgcgauaccgggacaaauccggccaacagagcucacgacgcgguccucgccacguauucugcuaaauacaccccuaagcugggaagcgugcaaaucggcacaugggauaccgaggaccuucuggaacggcagcccguuaaguucacacccguggggcucaaugagauuggacaggauaaacacuuugaccaauggguccugccuaacuacuccggcgcccuuggccugaauaugcaucucgccccggcugugagcccccuguucccuggggaacgccugcucuuuuucagaucuuauaucccccugaagggaggccacggggauccuuuuauugacugccuuguuccccaggaguggauccagcauuucuaccaggaauccgccccugcgcaaagcucuguggcucugcuccgguaugucaaccccgacaccggaagaacgcuguuugaggccaaacugcacaaggagggcuucauuacagugagcuccaccgaaaaucgcccggugaucguuccucccaacggguacuuucgguucgauucuugggucaaccaguuuuauagccuugccccuaugggcaccggaaauggcagacgccggaugcaguga

SEQ ID NO: 27954 - RNA, 1623 nt, Artificial Sequence
  derived and/or modified sequence opt5 from capsid_protein__Norovirus__AAS86795
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccuggcccgcauguauaauggguacgcuggaggcguggagguucaggugcugcucgccggcaacgcuuucaccgccgggaaacuggucuuugcggccauucccccucauuuccccguggauaaucuuucuccuggacagaucacaauguuuccccacguuaucaucgacgugagaacccuggaaccgguccuccugccucuucccgaugugcggaacaauuucuuucauuauaaccagcaaagcgaccagcgcaugagacugguggcuaugcucuacacaccucugcgguccaacggcucuggggaugacgucuucaccguuagcugccgcgugcugacaagacccucccccgauuuugacuucaauuaucucgugccuccgaccgucgagagcaagacgaaacccuuuucugugccuguucugacccuuaacgaacugacaaauucccgguuccccgugccuauugaugccauguacaccagccccaacgacucuaucgucgugcagccgcagaauggacgcgcuacaauugauggcgagcuccuggggaccacgcaacuuaucccuuccggaauuuguagcuuuagaggcaagaucacaacccaccugucugacgaccggcaucucuggaacauucagguuuccaaucugaacggcacacccuucgauccuaccgacgaugugcccgccccucuggggaugcccgacuucagcggacagaucuuuggcgucgugucccagcgcgauaccgggacaaauccggccaacagagcucacgacgcgguccucgccacguauucugcuaaauacaccccuaagcugggaagcgugcaaaucggcacaugggauaccgaggaccuucuggaacggcagcccguuaaguucacacccguggggcucaaugagauuggacaggauaaacacuuugaccaauggguccugccuaacuacuccggcgcccuuggccugaauaugcaucucgccccggcugugagcccccuguucccuggggaacgccugcucuuuuucagaucuuauaucccccugaagggaggccacggggauccuuuuauugacugccuuguuccccaggaguggauccagcauuucuaccaggaauccgccccugcgcaaagcucuguggcucugcuccgguaugucaaccccgacaccggaagaacgcuguuugaggccaaacugcacaaggagggcuucauuacagugagcuccaccgaaaaucgcccggugaucguuccucccaacggguacuuucgguucgauucuugggucaaccaguuuuauagccuugccccuaugggcaccggaaauggcagacgccggaugcaguga

SEQ ID NO: 27955 - RNA, 1623 nt, Artificial Sequence
  derived and/or modified sequence opt5 from capsid_protein__Norovirus__AAS86798
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccuggcccgcauguauaauggguacgcuggaggcguggagguucaggugcugcucgccggcaacgcuuucaccgccgggaaacuggucuuugcggccauucccccucauuuccccguggauaaucuuucuccuggacagaucacaauguuuccccacguuaucaucgacgugagaacccuggaaccgguccuccugccucuucccgaugugcggaacaauuucuuucauuauagccagcaauccgaccagcgcaugagacugguggcuaugcucuacacaccucugcggucuaacggcagcggggaugacgucuucaccguuuccugccgcgugcugacaagacccagccccgauuuugacuucaacuaucucgugccuccgaccgucgagucuaagacgaaacccuuuuccgugccuguucugacccuuaaugaacugacaaacagccgguuccccgugccuauugaugccauguacaccucucccaaugacuccaucgucgugcagccgcagaacggacgcgcuacaauugauggcgagcuccuggggaccacgcaacuuaucccuagcggaauuuguucuuuuagaggcaagaucacaacccaccuguccgacgaccggcaucucuggaauauucagguuagcaaccugaauggcacacccuucgauccuaccgacgaugugcccgccccucuggggaugcccgacuucuccggacagaucuuuggcgucgugucucagcgcgauaccgggacaaacccggccaauagagcucacgacgcgguccucgccacguauagcgcuaaauacaccccuaagcugggauccgugcaaaucggcacaugggauaccgaggaccuucuggaacggcagcccguuaaguucacacccguggggcucaacgagauuggacaggauaaacacuuugaccaauggguccugccuaauuacagcggcgcccuuggccugaacaugcaucucgccccggcugugucuccccuguucccuggggaacgccugcucuuuuucagauccuauaucccccugaagggaggccacggggauccuuuuauugacugccuuguuccccaggaguggauccagcauuucuaccaggaaagcgccccugcgcaaucuagcguggcucugcuccgguaugucaaucccgacaccggaagaacgcuguuugaggccaaacugcacaaggagggcuucauuacaguguccucuaccgaaaaccgcccggugaucguuccucccaauggguacuuucgguucgauagcugggucaaccaguuuuauucccuugccccuaugggcaccggaaacggcagacgccggaugcaguga

SEQ ID NO: 27956 - RNA, 1623 nt, Artificial Sequence; identical to SEQ ID NO: 27954
  derived and/or modified sequence opt5 from capsid_protein__Norovirus__AAS86801

SEQ ID NO: 27957 - RNA, 1623 nt, Artificial Sequence
  derived and/or modified sequence opt5 from capsid_protein__Norovirus__AAS86804
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgauucccccucauuuccccguugauaaucuuagcccuggacagaucacaauguuuccccacgugauuaucgacgucagaacccuggaaccggugcuccugccucuucccgaugugcggaacaauuucuuucauuauaaccagcaauccgaccagcgcaugagacugaucgccaugcucuacacaccucugcggucuaacggcagcggggaugacgucuucaccguuuccugccgcgugcugacaagacccagccccgauuuugacuucaauuaucucgugccuccgaccgucgagucuaagacgaaacccuuuuccgugccuguucugacccuuaacgaacugacaaauagccgguuccccgugccuauugaugcuauguacaccucucccaacgacuccgucgugguucagccgcagaauggacgcgccacaaucgauggcgagcuccuggggaccacgcaacuuauuccuagcggaaucuguucuuuuagaggcaagauuacaacccaccuguccgacgaccggcaucucuggaacauccaggugagcaaucugaacggcacacccuucgauccuaccgacgauguccccgcuccucuggggaugcccgacuucuccggacagauuuuuggcgugaucucucagcgcgauaccgggacaaauccggccaacagagcccacgacgcuguccucgcgacguauagcgccaaauacaccccuaagcugggauccgugcaaaucggcacaugggauaccgaggaccuucuggaacggcagcccguuaaguucacacccguggggcucaaugagauuggacaggauaaacacuuugaccaauggguccugccuaacuacagcggcgcucuuggccugaauaugcaucucgccccggccgugucuccccuguucccuggggaacgccugcucuuuuucagauccuauaucccccugaagggaggccacgggaacccuuuuauugauugccuuguuccccaggaguggauccagcauuucuaccaggaaagcgcuccugcccaaucuagcguggcgcugcuccgguaugucaaucccgacaccggaagaacgcuguuugaggcuaaacugcacaaggagggcuucauuacaguguccucuaccgaaaaccgcccggugaucguuccucccaacggguacuuucgguucgacagcugggucaaucaguuuuauucccuugccccuaugggcaccggaaacggcagacgccggaugcaguga

SEQ ID NO: 27958 - RNA, 1593 nt, Artificial Sequence
  derived and/or modified sequence opt5 from capsid_protein__Norovirus__AAS86807
augaugauggccagcaaggacgcuaccuccaacguggauggcgccucuggggcgggacagcugguccccgaagcuaauacaagcgacccucucgccauggauccgguugccggcuccucuacggcuguggccaccgcugggcaagugaaccccaucgacccuuggauuaucaauaacuucguccaggcgccccagggagaauuuacaauuagcccuaauaacacccccggcgaugugcuguucgaccuuucccuggggccucaccucaauccguuucugcuucaucugucucagauguacaacggauggguuggcaauaugagagugcggaucaugcucgccggcaacgccuucacagcugggaaaauuaucgucagcugcauucccccuggauuuggcucccacaaucugaccaucgcccaaagcacacuguucccccaugugaucgcugauguucgcacccucgacccuauugaggugccccuggaagaugucagaaacgugcuuuuucacaauaacgaccggaaucagcagacgaugcgccugguguguaugcucuauaccccgcugagaacagggggaggcaccggggauucuuucgucguugccggacgggugaugacaugcccuucccccgacuuuaacuuccuuuuucuggugccucccaccgucgagcagaagacgcgccccuucacacucccuaaccugccgcugagcucucucuccaauagcagagcgccccugccuaucucuuccaugggcauuagccccgauaacgugcaauccguucaguuucagaauggccgguguacccuugacgggcgccuggugggaacaaccccugucucucucagccagguggccaaaaucagaggcaccuccaacgggacaguuauuaaucugacggaacuugacggaacccccuuccauccguucgagggcccugcucccaucggguuuccugaucugggaggcugcgacuggcacgugaacaugacacaauucggccacagcucucagacccaguuugaugucgacacaacccccgagacguucgugccucaucucggguccauccaagccaauggagucggcagcgggaacuacauuggagugcugucuuggaucagcccgcccucccacccuucuggcagccagguugaucuguggaagauucccaauuauggguccagcaucacagaagcuacccaucucgcccccucuguguuuccuccgggcuucggagagguccugguguuuuucauguccaaaauucccggcccuggggccuacaaccuucccugucugcucccucaggaauauaucagccacuuugcuucugagcaggcgcccaccguuggagaggccgcucugcuucacuacguggacccugauacaggccggaaucugggggaguucaaggccuaucccgacggauuucugaccugcgucccgaacggcgccuccagcgggccucaacagcuccccaucaauggcguguucguguuuguuuccugggucucucgcuucuaccagcugaagccugugggaacagcuagcuccgccagaggccggcucgggcugcgcagauga

SEQ ID NO: 27959 - RNA, 1623 nt, Artificial Sequence
  derived and/or modified sequence opt5 from capsid_protein__Norovirus__AAT00237
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcgccuuucgcggcgaugucacacauaucgcuggcacccacaauuacaccaugaaccucgcgucucagaauuggaacaauuaugaccccacagaagagauuccugcuccccuggggacgccggauuucgugggaagaauccagggcaugcuuacccagacaacccgcggggacggauccacacggggccauaaagccaccgucagcacgggggacgugcacuuuacaccuaagcugggaucuauucaauucaacaccgauaccaauaacgacuuugaaacaggccagaauaccaaguucacacccguuggcgugguccaggaugggaacggaacgcaccaaaaugagccccagcagugggugcucccuuccuacagcggcagaaccgggcauaacguucaccuggccccggccguggcucccacauuuccuggagaacagcuucuguucuuucgguccaccaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaaguccggauacgucaccguggcccacacgggccaacaugaucucgugaucccgccuaauggguauuuucgguucgacagcugggucaaccaguucuacacccuggcucccaugggaaauggcacagggagacgccgggcccuuuga

SEQ ID NO: 27960 - RNA, 1623 nt, Artificial Sequence; identical to SEQ ID NO: 27959
  derived and/or modified sequence opt5 from capsid_protein__Norovirus__AAT00240

SEQ ID NO: 27961 - RNA, 1623 nt, Artificial Sequence; identical to SEQ ID NO: 27959
  derived and/or modified sequence opt5 from capsid_protein__Norovirus__AAT00243

SEQ ID NO: 27962 - RNA, 1623 nt, Artificial Sequence; identical to SEQ ID NO: 27959
  derived and/or modified sequence opt5 from capsid_protein__Norovirus__AAT00246

SEQ ID NO: 27963 - RNA, 1623 nt, Artificial Sequence
  derived and/or modified sequence opt5 from capsid_protein__Norovirus__AAT00249
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcgccuuucgcggcgaugucacacauaucgcuggcacccacaauuacaccaugaaccucgcgucucagaauuggaacaauuaugaccccacagaagagauuccugcuccccuggggacgccggauuucgugggaagaauccagggcaugcuuacccagacaacccgcggggacggauccacacggggccauaaagccaccgucagcacgggggacgugcacuuuacaccuaagcugggaucuauucaauucaacaccgauaccaauaacgacuuugaaacaggccagaauaccaaguucacacccguuggcgugguccaggaugggaacggaacgcaccaaaaugagccccagcagugggugcucccuuccuacagcggcagaaccgggcauaacguucaccuggccccggccguggcucccacauuuccuggagaacagcuucuguucuuucgguccaccaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaagaccggauacgucacgguggcccacaccggccaacaugaucucgugaucccgccuaauggguauuuucgguucgacuccugggucaaccaguucuacacacuggcucccaugggaaauggcaccgggagacgccgggcccuuuga

SEQ ID NO: 27964 - RNA, 1623 nt, Artificial Sequence
  derived and/or modified sequence opt5 from capsid_protein__Norovirus__AAT00255
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaagauucacgcccguuggcgugguccaggaugggaacggaacccaccaaaaugagccccagcagugggugcucccuuccuacagcggccggacagggcauaacguucaccuggcuccggccguggcccccaccuuuccuggagaacagcuucuguucuuucgcuccacaaugcccggcuguucuggguacccuaacaugaaucucgacugccugcugccccaagaguggguccagcauuucuaucaggaggcugccccugcgcagagcgauguggcucuccugagauuugugaaccccgacaccggccggguucuuuucgaauguaagcugcacaaauccggauacgucacgguggcccacaccggccaacaugaucucgugaucccgccuaauggguauuuuagauucgacagcugggucaaccaguucuacacacuggcccccaugggaaauggcaccgggcgccggagagcucuuuga

SEQ ID NO: 27965 - RNA, 1623 nt, Artificial Sequence; identical to SEQ ID NO: 27964
  derived and/or modified sequence opt5 from capsid_protein__Norovirus__AAT00258

SEQ ID NO: 27966 - RNA, 1623 nt, Artificial Sequence; identical to SEQ ID NO: 27964
  derived and/or modified sequence opt5 from capsid_protein__Norovirus__AAT00261

SEQ ID NO: 27967 - RNA, 1623 nt, Artificial Sequence; identical to SEQ ID NO: 27964
  derived and/or modified sequence opt5 from capsid_protein__Norovirus__AAT00264

SEQ ID NO: 27968 - RNA, 1623 nt, Artificial Sequence; identical to SEQ ID NO: 27964
  derived and/or modified sequence opt5 from capsid_protein__Norovirus__AAT00267

SEQ ID NO: 27969 - RNA, 1623 nt, Artificial Sequence; identical to SEQ ID NO: 27964
  derived and/or modified sequence opt5 from capsid_protein__Norovirus__AAT00270

SEQ ID NO: 27970 - RNA, 1623 nt, Artificial Sequence; identical to SEQ ID NO: 27964
  derived and/or modified sequence opt5 from capsid_protein__Norovirus__AAT00273

SEQ ID NO: 27971 - RNA, 1623 nt, Artificial Sequence; identical to SEQ ID NO: 27964
  derived and/or modified sequence opt5 from capsid_protein__Norovirus__AAT00276

SEQ ID NO: 27972 - RNA, 1623 nt, Artificial Sequence; identical to SEQ ID NO: 27964
  derived and/or modified sequence opt5 from capsid_protein__Norovirus__AAT00279

SEQ ID NO: 27973 - RNA, 1623 nt, Artificial Sequence; identical to SEQ ID NO: 27964
  derived and/or modified sequence opt5 from capsid_protein__Norovirus__AAT00282

SEQ ID NO: 27974 - RNA, 1623 nt, Artificial Sequence; identical to SEQ ID NO: 27964
  derived and/or modified sequence opt5 from capsid_protein__Norovirus__AAT00285

SEQ ID NO: 27975 - RNA, 1623 nt, Artificial Sequence; identical to SEQ ID NO: 27964
  derived and/or modified sequence opt5 from capsid_protein__Norovirus__AAT00288

SEQ ID NO: 27976 - RNA, 1623 nt, Artificial Sequence; identical to SEQ ID NO: 27964
  derived and/or modified sequence opt5 from capsid_protein__Norovirus__AAT00291

SEQ ID NO: 27977 - RNA, 1623 nt, Artificial Sequence; identical to SEQ ID NO: 27964
  derived and/or modified sequence opt5 from capsid_protein__Norovirus__AAT00294

SEQ ID NO: 27978 - RNA, 1623 nt, Artificial Sequence; identical to SEQ ID NO: 27964
  derived and/or modified sequence opt5 from capsid_protein__Norovirus__AAT00297

SEQ ID NO: 27979 - RNA, 1623 nt, Artificial Sequence; identical to SEQ ID NO: 27964
  derived and/or modified sequence opt5 from capsid_protein__Norovirus__AAT00300

SEQ ID NO: 27980 - RNA, 1623 nt, Artificial Sequence; identical to SEQ ID NO: 27964
  derived and/or modified sequence opt5 from capsid_protein__Norovirus__AAT00303

SEQ ID NO: 27981 - RNA, 1623 nt, Artificial Sequence; identical to SEQ ID NO: 27964
  derived and/or modified sequence opt5 from capsid_protein__Norovirus__AAT00306

SEQ ID NO: 27982 - RNA, 1623 nt, Artificial Sequence; identical to SEQ ID NO: 27964
  derived and/or modified sequence opt5 from capsid_protein__Norovirus__AAT00309

SEQ ID NO: 27983 - RNA, 1623 nt, Artificial Sequence; identical to SEQ ID NO: 27964
  derived and/or modified sequence opt5 from capsid_protein__Norovirus__AAT00312

SEQ ID NO: 27984 - RNA, 1623 nt, Artificial Sequence; identical to SEQ ID NO: 27964
  derived and/or modified sequence opt5 from capsid_protein__Norovirus__AAT00315

SEQ ID NO: 27985 - RNA, 1623 nt, Artificial Sequence; identical to SEQ ID NO: 27964
  derived and/or modified sequence opt5 from capsid_protein__Norovirus__AAT00318

SEQ ID NO: 27986 - RNA, 1623 nt, Artificial Sequence; identical to SEQ ID NO: 27964
  derived and/or modified sequence opt5 from capsid_protein__Norovirus__AAT00321

SEQ ID NO: 27987 - RNA, 1623 nt, Artificial Sequence; identical to SEQ ID NO: 27959
  derived and/or modified sequence opt5 from capsid_protein__Norovirus__AAT00324

SEQ ID NO: 27988 - RNA, 1623 nt, Artificial Sequence
  derived and/or modified sequence opt5 from capsid_protein__Norovirus__AAT00330
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugguccaggaugggaacggaacccaccaaaaugagccccagcagugggugcucccuuccuacagcggcagaacagggcauaacguucaccuggcuccggccguggcccccaccuuuccuggagaacagcuucuguucuuucgguccgcuaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaaguccggauacgucaccguggcccacacgggccaacaugaucucgugaucccgccuaauggguauuuucgguucgacagcugggucaaccaguucuacacccuggcucccaugggaaauggcacagggagacgccgggcccuuuga

SEQ ID NO: 27989 - RNA, 1623 nt, Artificial Sequence; identical to SEQ ID NO: 27988
  derived and/or modified sequence opt5 from capsid_protein__Norovirus__AAT00333

SEQ ID NO: 27990 - RNA, 1623 nt, Artificial Sequence; identical to SEQ ID NO: 27988
  derived and/or modified sequence opt5 from capsid_protein__Norovirus__AAT00336

SEQ ID NO: 27991 - RNA, 1623 nt, Artificial Sequence
  derived and/or modified sequence opt5 from capsid_protein__Norovirus__AAT00342
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuguucaauucaacaccgauacaaauaacgacuuugaaaccggccagaauacaaaguucacgcccgugggcgucgugcaggaugggaacggagcucaccaaaaugagccccagcaguggguucucccuuccuacagcggcagaaccgggcauaacgugcaccuggccccggccgucgcucccacauuuccuggagaacagcuucuguucuuucgguccaccaugcccggcuguucuggguacccuaacaugaaucucgacugccugcugccccaagagugggugcagcauuucuaucaggaggccgcgccugcucagagcgauguggcccuccugcgcuuuguuaaccccgacacaggcagaguccuuuucgaauguaaacugcacaaguccggauacgugaccguggcccacacgggccaacaugaucucgucauuccgccuaauggguauuuucgguucgacagcugggugaaccaguucuacacccuggcucccaugggaaauggcacagggagacgccgggcccuuuga

SEQ ID NO: 27992 - RNA, 1623 nt, Artificial Sequence; identical to SEQ ID NO: 27964
  derived and/or modified sequence opt5 from capsid_protein__Norovirus__AAT00345

SEQ ID NO: 27993 - RNA, 1623 nt, Artificial Sequence
  derived and/or modified sequence opt5 from capsid_protein__Norovirus__AAT00348
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaagauucacgcccguuggcgugguccaggaugggaacggaacccaccaaaaugagccccagcagugggugcucccuuccuacagcggccggacagggcauaacguucaccuggcuccggccguggcccccaccuuuccuggagaacagcuucuguucuuucgcuccacaacccccggcuguucuggguacccuaacaugaaucucgacugccugcugccccaagaguggguccagcauuucuaucaggaggcugccccugcgcagagcgauguggcucuccugagauuugugaaccccgacacgggccggguucuuuucgaauguaagcugcacaaauccggauacgucaccguggcccacacaggccaacaugaucucgugaucccgccuaauggguauuuuagauucgacagcugggucaaccaguucuacacccuggcccccaugggaaauggcacagggcgccggagagcucuuuga

SEQ ID NO: 27994 - RNA, 1623 nt, Artificial Sequence; identical to SEQ ID NO: 27964
  derived and/or modified sequence opt5 from capsid_protein__Norovirus__AAT00351

SEQ ID NO: 27995 - RNA, 1623 nt, Artificial Sequence; identical to SEQ ID NO: 27964
  derived and/or modified sequence opt5 from capsid_protein__Norovirus__AAT00354

SEQ ID NO: 27996 - RNA, 1623 nt, Artificial Sequence; identical to SEQ ID NO: 27964
  derived and/or modified sequence opt5 from capsid_protein__Norovirus__AAT00357

SEQ ID NO: 27997 - RNA, 1623 nt, Artificial Sequence; identical to SEQ ID NO: 27964
  derived and/or modified sequence opt5 from capsid_protein__Norovirus__AAT00360

SEQ ID NO: 27998 - RNA, 1623 nt, Artificial Sequence; identical to SEQ ID NO: 27959
  derived and/or modified sequence opt5 from capsid_protein__Norovirus__AAT00363

SEQ ID NO: 27999 - RNA, 1623 nt, Artificial Sequence; identical to SEQ ID NO: 27964
  derived and/or modified sequence opt5 from capsid_protein__Norovirus__AAT00366

SEQ ID NO: 28000 - RNA, 1623 nt, Artificial Sequence; identical to SEQ ID NO: 27964
  derived and/or modified sequence opt5 from capsid_protein__Norovirus__AAT00369

SEQ ID NO: 28001 - RNA, 1623 nt, Artificial Sequence; identical to SEQ ID NO: 27964
  derived and/or modified sequence opt5 from capsid_protein__Norovirus__AAT00372

SEQ ID NO: 28002 - RNA, 1623 nt, Artificial Sequence; identical to SEQ ID NO: 27964
  derived and/or modified sequence opt5 from capsid_protein__Norovirus__AAT00375

SEQ ID NO: 28003 - RNA, 1647 nt, Artificial Sequence
  derived and/or modified sequence opt5 from capsid_protein__Norovirus__AAT70110
augaagauggccagcaaagacgcuacccccuccaacgauggcgccgcggggcuggugccugagaucaauaacgaagcuauggcccucgacccggucgccggagcugccauugcugcgccccugacaggccagcaaaauaucauugauccuuggaucaugaacaauuucguucaggcccccgggggagaguuuacggugucuccuagaaacagccccggcgaagugcuucugaaucucgagcuggggccugaaauuaacccguaccuugcccaccuggcucggauguauaauggauacgccggcggcuucgagguccaggugguucucgcugggaacgccuuuaccgcgggaaagaucaucuucgccgcuauucccccuaauuuucccaucgacaaccuguccgccgcucagauuacaaugugcccucaugugaucgucgaugugcgccaacuggagcccguuaaucucccgaugccugacgugagaaacaauuucuuucacuauaaccagggcucugauagccggcugcgccuuauugccaugcuguacacaccccucagagccaacaauuccggggacgaugucuucaccgugucuugucgggugcugacccgcccuagccccgacuuuuccuucaacuuucuuguucccccuacagucgaaagcaaaaccaagccguucacgcugcccauccucaccauuucugagauguccaauagcagauuuccugugcccaucgauucucugcauacauccccuaccgaaaacaucgugguccagugccagaauggacgggugacacuggacggcgagcucauggggaccacgcaacugcuucccagccagauuugugcuuuccgcggaguucugacaagaucuaccucccgggcgagcgaucaggccgacacagcuaccccgcgccucuucaacuauuacuggcacauccagcuggacaaucuuaacggcaccccuuaugaucccgccgaggacauuccuggcccccuggggacaccugauuuuagaggaaaaguguucggcgucgccucccaacggaaucccgacucuacgacccgcgcucaugaagccaagguggauacaaccgcggggagauuuacaccgaagcucggaagccuggagaucuccaccgaaagcggcgacuucgaucagaaccagccuacgcgguuuacacccguugggauuggaguggacaaugaggcugauuuccaacaguggucucugcccgacuacuccggccaguuuacccacaacaugaaucucgccccugccgucgcuccgaacuuccccggcgaacagcugcuguuuuucagaagccaacuuccuucuagcgggggacgcuccaauggcauccucgauugccuggugccccaggaguggguccagcacuuuuaccaggagucugccccuagccaaacccagguggcucuuguucgguaugugaaccccgacacagggagaguccuguucgaagccaaacuccauaagcugggauuuaugaccaucgcgaaaaacggcgacuccccuauuacagugcccccgaauggguacuuccgcuucgagagcuggguuaacccuuuuuauacgcuggcccccaugggcaccggaaauggccggagacgcauccaguga

SEQ ID NO: 28004 - RNA, 1623 nt, Artificial Sequence
  derived and/or modified sequence opt5 from capsid_protein__Norovirus__AAT73592
auggccagcaaggacgcugcccccuccaccgauggcgcggcugggcuggugccugagucuaacaaugaagucauggcccucgagccgguugccggagcugcccuggcugcccccgugacaggccagacgaacaucauugacccuuggaucagaaccaauuucgugcaagcgcccaacggggaauuuacagucagcccuagaaaugcccccggagaggugcuucugaaccucgaacugggcccugagcuuaauccguaccuggcucaccucgcccgcauguauaacggguacgcuggaggcauggagguucaggugaugcuggccggcaaugcguucaccgccgggaaacuggucuuugcugccgugcccccucauuuccccguugaaaaccucuccccucagcagauuacaauguuuccccacgugaucauugaugucagaacccuggagccggugcuucugccucuccccgacgugcggaauaacuucuuucauuauaaucaaaaggaugacccuaaaaugcgcaucgucgcuaugcuguacacaccccuuagaucuaacggaagcggcgaugacguuuucaccguguccugccgggugcugacgcgccccucuccugauuuugacuucaccuaucucgucccgcccacaguggaaagcaagaccaaaccuuuuacacugcccauccugacccucggggagacguccaauagcagauucccuguucccauugaucagauguacacaucuccgaacgaggugaucuccguccagugucagaacggacggugcacccuggacggcgaacuucaagggacaacccagcugcaagugagcggaauuugugccuuuaagggccagguuaccgcccaccuccaggauaaugagcaucuguauaacgugacaaucacgaaucuuaacggcucuccuuucgaccccuccgaagacauuccugcuccccugggggucccugauuucgagggacgcguguuuggcgucaucagccagagagacaauuacaacucugggggacagaaucaacccgcgaaccggucccacgaugccgugguuccgaccuacacagcucaguauaccccuaagcucggccagauucagaucgggacauggcaaaccgacgauaucacgguggaccagcccgccaaauucacacccgucggacugagcgauaccgaccacuuuaaucagugggugguuccucgcuacgccggcgcucugaaccucaauaccaaccuggccccguccguggcgcccgucuucccuggcgaaagacuucuguuuuuccggucuuauauuccccucaaagggggauuuggcaauccugcuaucgauugccuggugccccaggaguggauucaacauuucuaccaggaggccacaccuagccuuuccgaaguggcccugguucgcuauaucaaccccgacaccgggagagcucucuuugaggccaagcugcaccgggcuggauucaugacagucagcucuaauacguccgccccggugguggucccugcgaacggcuacuuuagauucgauagcugggugaaccaguuuuauucucuggcccccauggggaccggcaauggacgccggcggauucaguga

SEQ ID NO: 28005 - RNA, 1614 nt, Artificial Sequence
  derived and/or modified sequence opt5 from capsid_protein__Norovirus__AAT78480
auggccagcaaggacgcugcccccuccaacgauggcgcgaccgggcuggugccugagaucaauacagaaacgcucccgcuggagcccgucgcuggagccgccauugcugccccuguuaccggccagaacaauaucauugaccccuggaucagaaacaauuucgugcaagcuccuaacggggaauuuacagugucuccccggaauagcccuggagagauucuuaugaaccuggaacucggcccggaucugaaucccuaccuugcccaccugucccgcauguauaacggguacgcgggaggcgucgaggugcagguucuccuggccggcaaugcuuucaccgccgggaaaauccuguuugcugccgugccucccaacuucccugucgacaugcucucucccgcgcagaucacaaugcugccgcaucuuauuguggauguuagaacccuggagccuaucaugauuccccucccugacgugcggaaugucuuuuaucacuucaacaaucagcccgcuccccgcaugagacugguggccaugcuuuacacaccucugcggagcaacggauccggcgaugacguguuuaccgucucuugccgcguucucacgagaccgacccccgauuucgaauuuacauaucuggugccucccagcguggaguccaagaccaaaccuuucacacugcccauccucaccauuggggaacugacgaacagccgguuuccggccccuaucgaccaacuuuacacaucucccaaugcugaugucgugguucagccucagaacggacgcuguucccuggacggcgagcuccaggggaccacacaacugcuuaccaccgccauuugcagcuauagaggaaugacaucuaaucccacgcgggauuacugggacggccaucugcuccaccuggugcauccuaacggcgccaccuacgaccccacagaggaugucccggcuccuuucgggacccaggacuuucgcggaauccuguauggcgugcucacacagaaucccagagcguccggggaugaagccgcuaacagccagggaguuuacaucucuuccaccagcgagaaguucacgcccaaacugggcacaauugggcuucaccaagugcagggacaccauucccagcaccaacagucuaaguucaccccucugggcgucgccgugaauggcaacaccccguuucggcagugggaacuccccaauuauagcggggcccugacacuuaacaccaaucuggcuccugccgucggacccaacuucccuggcgagcagauccucuuuuuccgcuccaaugugcccagcguucaagggggacagccuauugaaaucgacugucugauuccccaggagugggugucucauuuuuaccaggaguccgcgccgagccaaucugaugucgcucuggugagauauguuaacccugacacaggccggacgaucuucgaagccaagcuccacagacagggguuuaucaccauugccgcuacaggcagcaaucccguggucgugccucccaacggauacuuccgcuuugauuccugggugaaccaguucuaugcccuggcuccgaugggcaccgggaauggacggagacgcauccaguga

SEQ ID NO: 28006 - RNA, 1635 nt, Artificial Sequence
  derived and/or modified sequence opt5 from capsid_protein__Norovirus__AAT78481
auggccagcaaggacgcucccuccaacauggauggcaccucuggggccggacagcuggugccugaggcgaauacagcugacccgaucccccucgaaccugucguuggcgccgccacggcugccgcuaccgccgggcaagugaacaugauugaucccuggaucaugaauaacuucgugcagagcccugagggagaauuuacaauuucccccaauaacaccccuggcgacauccuguucgaucuucagcuggggccgcaccucaaucccuuucugcagcaucuuucucaaauguacaacggaugggucggcaauaugagagugcggauucugcucgcgggcaacgccuucagcgcugggaaaaucaucauuugcuguguuccucccggauuuacagcccagaauaucuccauugcucaggccaccauguucccucacgugaucgcggacguccgcgugcuggagcccauugaaaucccgcuggaugacguuagaaacgugcucuuucauacaaaugagaaccggccuaccaugcgccugcuuugcaugcuguauacgccccucagagccggcggggcuucugccggaaccgauccuuucgucauugcuggccgggugcugacaugucccagccccgacuuuaauuuccuuuuucuggugccuccguccgucgagcagaagacccgccaacucacaguucccaacaucccucugaacaaucugagcaacucuuccgugcccgccaugaucaauaaaauggccauuagcucugaugcuaaccaggugguccaguuccagaaugggagaugcaccacggacggacaacuccugggcacaaccccuaucuccgcgagccagguggcccggauucgcggcaagguguuuucuacauccagcgggaaaggacuuaaccuguccgaacucgauggcucucccuaccacgcuuucgagagcccggccccuguuggguuccccgaccugggacauugugacuggcacgucuccagcuuuaaggccgaucaaaauucuuccggcgacccuaucagcagacuugauauuaagcagggggcuucuuucgcgccccaccugggaagcaucgaauauaccaccucccagaacccugacggcggccagcucgggacacugacguggaucucuagccccuccgaugacaccccgggacauggcacaauuaaucuguggaaaaucccuagcuacgggucuaccgugacagaguccguucaccucgccccucccauuuaucccccgggauuuggcgagacccuggugaaccuuaugagcaauuuccccaucgggcauacgaacucuaauauggcucaggucccuugcacacugccccaagaauuuguggcccacuucgucaacgagcaggccccugugcggggcgaugcugcccuccugcacuacguugaccccgauacccaucgcaaucuuggagaauuuaagcuguauccugagggcuacauuaccugugugcccaacacagggggaggcgggccgcagucccucccuaccaacggagucuucaucuuuagcuccugggugucuagauacuaucagcuggaacccguuggcacagcugggccugcccggcgccugggcgugagacgggucuga

SEQ ID NO: 28007 - RNA, 1620 nt, Artificial Sequence
  derived and/or modified sequence opt5 from capsid_protein__Norovirus__AAU95776
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucaucguggacgugagacaacucgagccuguccugauuccccugccugauguucggaauaacuuuuaucacuacaaucagucuaacgacagcaccaucaagcucauugcuaugcuguauacaccccuuaaagccaacaaugcuggcgaugacguguucaccguguccugccgcguccugacaagacccagcccugauuuugacuucaucuuucucgugccgcccaccguugaaucucggacgaagccuuucaccgugcccauucugacagucgaggaaauguccaacagccgcuuuccuaucccccuugagaaacuguacaccgggccgucuuccgccuucgugguucagccucagaauggaagauguacaaccgauggcgugcuccuggggacgacacaacugagcgccgucaacauuugcaccuuccggggagacgugacacauaucgcuggcucucacgauuauaccaugaaucucgcgucccagaacuggaauaacuacgaccccaccgaggaaaucccugcuccccugggcacaccugacuuugucgggaagauucagggaaugcuuacgcagaccacacgcgaggauggcagcaccagagcccauaaggccacaguguccaccgggucuguucacuucacgcccaaacugggaagcgugcaauacacaaccgacaccaauaacgauuuucagacaggccagaauaccaaguucacaccggucggggugauccaagacggaaacaaucaccagaacgaaccucagcaguggguucuccccaauuauuccggccggacgggccauaacgugcaccuggcccccgcugucgccccuaccuuuccgggggagcaacuucuguucuuucgcagcacaaugcccggauguucuggcuacccuaacaugaaucucgauugccugcugccccaggaaugggugcagcauuucuaucaggaggcggcuccugcccaauccgacguggcccuccugagauuuguuaaccccgauaccgggcggguccuuuucgaguguaaacugcacaagagcggauacgugacaguggcucacaccggcccucaugaccucgucauucccccgaauggguauuuucgcuucgauucuugggugaaccaguuuuacacgcuggccccuaugggcaauggagcuggcagacggagagcccuuuga

SEQ ID NO: 28008 - RNA, 1644 nt, Artificial Sequence
  derived and/or modified sequence opt5 from capsid_protein__Norovirus__AAX32874
augaagauggccagcaacgacgcugcccccuccaccgauggcucugcggggcuggugccugaggucaauaacgaaacaauggcucucgagccgguugugggagcuccccuggccgccccuguggccggccagcacaauaucauugaccccuggaucaaaaugaacuucguccaagcuccuaauggggaauuuacggugagccccagaaacgccccuggagagauucuucuggaucucgaacugggcccggaccuuaaucccuaccugucccaucucgcgcggauguauaacggguacgccggaggcauggagguucaggugguccuggcuggcaaugccuucaccgcugggaagaucauuuuugccgcggugccucccaacuucccugccgagaaucugucugcugcccagguuacaaugugcccccacgugaucgucgaugugcgccagcucgaaccggugaugcugccuaugcccgacaucagaaacaaacuuuuucauuauaaucaagucgaugacccuaagcugcggcuccuggcuuaccuuuauacaccccugcgcgccaacaaugccggagaugacguuuucaccgugagcuguagagugcucacccggcccacaccugauuuugaguucauguuucuggucccgcccaccguggaauccaaaacgaagccuuucucucugcccagccucacccuggacgagcuuuccaacagccgcuuuccugcucccauuguucagcuguacacaaacccgcacgauaaucucgugguccagccucagaacggcagaugcaccaucgacgggcugcuucaaggaacaacccagcuggugucuuguaauguuugcuccuuccggggcacgauuggggacggacagcccgcgagccauucugaggaagagaucaugccuauggccuuuaacauucagcgcgaaaucaugcucgagaaucuggauggcucccccuaugacccugcugaugacauucccgccgugcugggcagcccggauuuccaagggaucgucuucggagugcucucucagagaaacgccgacggccagacacgggcucacgaagccaaggucgauacccgcgcggcuagauuugccccuaaacugggguucgugguugccacaguggaguccaccgacuuucacgcuaaucaacccagccgguucacccccgucggacuuggcggggauggaaaccaggacuuuaaucagugggcccugccugcuuacggcggcgcccucacaaacaauacgaaccuggcgccgcccgugaugccuguuuaccccggggagcagauccuuuauuuccgcucccaacugccuucuagcggaggcguggucgggggauggcucgauugucugcugccccaggaaugggugcagcacuuuuuccaggaguccgccaccagccaaucugacguggcucucguuagauacauuaauccuacaaccggccggguccuguuugaagccaaacuucauaagcagggguuccugacaguggcugccuccggcagcuauccccucguggucccggcggacggauacuuuagauucgagucuugggugaaccaguuuuauacccuggccccuaugggcaaugggagcggacgccggagaacgcgcuga

SEQ ID NO: 28009 - RNA, 1674 nt, Artificial Sequence
  derived and/or modified sequence opt5 from capsid_protein__Norovirus__AAX32877
augaugauggccagcaacgacgcuaccgcccccacagauggcgcggcugggcuggugccugaggucacgaaugaaaccauggcccucgagccgguugccggagcugcccuggcugcccccguggugggccagcacaacgucaucgacccuuggauuagagggaauuucgugcaagcgcccaacggagaauuuacaguuuccccucgcaauucucccggcgaggugcuucugaaccucgaacuggggccugagcuuaauccguaccuggcccaucucgcucggauguauaacggauacgccggcggcauggagguccaggugguucuggcugggaaugccuucgcggccggaaagaucauuuuugcugccgugcccccuagcuuccccgucgaugcucuguccgccccuaccaucacaaugugcccccacgugauuguggacgucagacagcucgaaccgguucugcuuccuaugcccgaugugcggaacaacuuuuuccauuauaaucagucuagcgacccuaaacugcgccucguggccaugcuguacacaccccuuagagcuaauucccccaccgaugacgucuuuaccgugucuugucggguucugacgcgcccuagcccggauuucgaguuuaccuuccucauucccccuacaguggaauccaagagcaaacccuuuaccaucccucaacugacacugucugagcucuccaacagcagauuccccgcgccgaucgacaugcuguauaccucuccuaaugauaacaucgucgugcagccccagaacggccggugcacgcuugacggggagcugcagggaacaacccaacuccagccuucccugauuuguagcuuucgcggcguuacacuuaaugaaaccucuagaaugcugguggaucaggaggaagaggaagagggggagguccagcggccccaagcccgcgcuuucaaccacgaauaccaucuccagcugcagaaucuggacggaaccgacuaugauccugccggcgaccuccccgccacacugggcgcuccggauuucaucgggacgguguacggagucgugucccaaagaaccacacgggacagcgccgcgcgcgcucacgaggccaagauuaccacauccgauccuagauacgcccccaaacuuggcucuguugaauuugugaccgagagcacggacaucguccugaacgaucagacaaaguucacccccguggggcucgcucacaaucgggccguugacuauaagcagugggaacugccucauuacgcuggagagcuuaccgccaacacaaaucuggcgccgcccguggccccugucuaucccggcgagcagcuccuguuuuucagauccaaccugccucucgcugggggaaccgccgcuagcgugcuggauugccuucugccccaagaauggauucagcacuuuuaccaggagucuuucgccccucaguccgacaucgcgcuccugcgcuaugugaaucccgauacaggccggguucuguuugaagccaaacuucauagacaaggcuacaucacggucgcuggggccggaaccagcccgguggcugugccucccaacggcuauuuccgcuuugagucuugggucagccaguucuacacacucgccccuaugggguccggaaccggccggagacgcaaucaguga

SEQ ID NO: 28010 - RNA, 1674 nt, Artificial Sequence
  derived and/or modified sequence opt5 from capsid_protein__Norovirus__AAX32880
augaugauggccagcaacgacgcuaccgcccccacagauggcgcggcugggcuggugccugaggucacgaaugaaaccauggcccucgagccgguugccggagcugcccuggcugcccccguggugggccagcacaacgucaucgacccuuggauuagagggaauuucgugcaagcgcccaacggagaauuuacaguuuccccucgcaauucucccggcgaggugcuucugaaccucgaacuggggccugagcuuaauccguaccuggcccaucucgcucggauguauaacggauacgccggcggcauggagguccaggugguucuggcugggaaugccuucgcggccggaaagaucauuuuugcugccgugcccccuagcuuccccgucgaugcucuguccgccccuaccaucacaaugugcccccacgugauuguggacgucagacagcucgaaccgguucugcuuccuaugcccgaugugcggaacaacuuuuuccauuauaaucagucuagcgacccuaaacugcgccucguggccaugcuguacacaccccuuagagcuaauucccccaccgaugacgucuuuaccgugucuugucggguucugacgcgcccuagcccggauuucgaguuuaccuuccucauucccccuacaguggaauccaagagcaaacccuuuaccaucccucaacugacacugucugagcucuccaacagcagauuccccgcgccgaucgacaugcuguauaccucuccuaaugauaacaucgucgugcagccccagaacggccggugcacgcuugggggagagcugcagggcacaacccaacuccagccuucccugauuuguagcuuucgcgggguuacacuuaaugaaaccucuagaaugcugguggaccaggaggaagaggaagagggagagguccagcggccccaagcccgcgcuuucaaccacgaauaccaucuccagcugcagaaucuggauggcaccgacuaugacccugccggcgaucuccccgccacacugggggcuccggacuucaucggaacgguguacggcgucgugucccaaagaaccacacgggauagcgccgcgcgcgcucacgaggccaagauuaccacauccgacccuagauacgcccccaaacuugggucuguugaauuugugaccgagagcacggauaucguccugaacgaccagacaaaguucacccccgugggacucgcucacaaucgggccguugauuauaagcagugggaacugccucauuacgcuggcgagcuuaccgccaacacaaaucuggcgccgcccguggccccugucuaucccggggagcagcuccuguuuuucagauccaaccugccucucgcuggaggcaccgccgcuagcgugcuggacugccuucugccccaagaauggauucagcacuuuuaccaggagucuuucgccccucaguccgauaucgcgcuccugcgcuaugugaaucccgacacaggccggguucuguuugaagccaaacuucauagacaaggguacaucacggucgcuggagccggcaccagcccgguggcugugccucccaacggguauuuccgcuuugagucuugggucagccaguucuacacacucgccccuaugggauccggcaccgggcggagacgcaaucaguga

SEQ ID NO: 28011 - RNA, 1647 nt, Artificial Sequence
  derived and/or modified sequence opt5 from capsid_protein__Norovirus__AAX32886
augaagauggccagcuccgacgcugcccccucuagcgauggcuccgcggggcuggugccugaggucaacucugaaaccauggcucucgagccgguugugggagcuccccuggccgccccuguggccggccagcacaauaucauugaccccuggaucaaacuuaacuucguccaagcuccuaauggggaauuuacagugagccccagaaacgccccuggagagauucugcucgaucuggaacuuggcccggaccugaaucccuaccucgcgcaucugucccggauguauaacgccuacgcugggggaauggagguucaggugauccuggccggcaaugcuuucacggccggcaagauuaucuuugcggccgucccucccaacuucccucucgagaaucugucugcugcccagaucaccaugugcccccacauuaucguggauguucgccagcuugaaccggugaugcugccuaugcccgacgucagaaaccggcucuuucauuauaaucaagugcgcgagccuagacugcggcuuguggcuuaccuguauacaccccuccgcgccaacaaugccggggaugacgucuucaccguuagcuguagagugcugacacggcccucccaggauuuugaguucauguuucuggugccuccgagcgucgaaucuaaaaccaagcccuucucccucccuaaccugacacuugcugagcugagcaauucucgcuuuccccucccuauugaacagcuguacaccaacccccuugacaaccuggugguucagccgcaaaauggaagaugcacgaucgauggcauucuccuggggaccacacagcuggugccuucccucaucuguagcaugcggggaacccuggaggcggaccaggccucuggccacacagaugacgaauccguccagagccgcgcuuucaacagacaacggucccuuaugcuggagaaucccgacgggucugccuuugauccuagcgacgaagugcccgccguucucggagugccugauuuccgcggcgucguguucggcguccugucccagagaaacaauggggacaccacgcggagccaugaggcuaaaauugauacaagacgcccccgguaugccccgaaacuuggauuuguggagguucugaccgaaucugacgauuuccagaacggcccucccacaaaguuuacccccguggggcucggaggcgacgggaauccugauuuccaacagugggcgcugccggacuacggaggcgcucugaccaacaauacaaaccucgcucccccugucgugcccguuuacccuggcgagcagauccuguuuuucagaucccagcuucccagcucugggggaacgguggccggcuggcuggauugccuccugccucaagaauggauccagcacuuuuaucaggacagcgccgccgcucaguccgacgucgcccuggugcgcuacauuaaucccgcgaccgggcgggugcuuuucgaggccaagcuccacagacaaggauuucugacaguuucugcugccggcccgcauccugucguggcucccgccgauggguauuuccgcuuugaaagcugggugaaccaguucuacacccuggcgccuaugggcaauggauccggccggagacgcgucuauuga

SEQ ID NO: 28012 - RNA, 1623 nt, Artificial Sequence
  derived and/or modified sequence opt5 from capsid_protein__Norovirus__AAZ31376
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagaggugcugagccccucccaggucaccauguucccgcauaucauuguggacgugagacaacucgagccuguccugaucccccugccugauguucggaacaaucucuaucacuacaaccagucuaaugaccccacaauucgccugaucgcuaugcuuuauacaccccugagagccaacaacgcuggagaugacguguuuaccgugagcugccggguccucacccgcccuuccccggauuucgacuuuauguuccuggugcccccuacgguugaaagcagaaccaagcccuuuucugugccuauucuuacagucgaggaaaugaccaauucccgguuccccaucccgcuggagaaacucuuuacaggcccuagcucugccuucgugguucagccccagaacgggcgcuguaccacggauggagugcugcugggcacaacccaacucuccccugucaauauuugcacauucagaggggacgugacccauaucgccggagcucagaacuacaccaugaaucuggcgagccagaacuggaauaacuaugaucccacagaggaaaucccugcuccccuuggcacgccggacuuugucggcaagauucagggggugcugacccaaacaacccggcgcgacggaucuacaagaggccacaaagccaccguuuccacggggagcgugcauuucacaccuaagcucggauccguccaguuuucuaccgauaccagcaaugacuucgagacaggccagaacacccgguuuacacccguggggguugugcaagauggauccacgacccaccagaaugaaccccagcaguggguccugccugacuacagcggccgcgauucucacaacgugcaucuugccccggccguggcucccacauucccuggcgagcaacugcucuuuuucagauccaccaugcccggguguagcggauacccuaauaugaaccuggacugccugcucccccaggaauggguucagcacuuuuaucaggagucugccccugcgcaaagcgaugucgcucugcuucgguucgugaaucccgacacaggcagagugcuguuugaguguaagcuccauaaauccggguacgucaccguggcccacacgggacagcacgaucugguuaucccgccuaacggcuauuuccgcuuugacucuuggauuaaccaguucuacacccuugcccccauggggaauggcgcuggacggagacgcgcccuguga

SEQ ID NO: 28013 - RNA, 1623 nt, Artificial Sequence
  derived and/or modified sequence opt5 from capsid_protein__Norovirus__AAZ31396
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagaggugcugagccccucccaggucaccauguucccgcauaucauuguggacgugagacaacucgagccuguccugaucccccugccugauguucggaacaaucucuaucacuacaaccagucuaaugaccccacaauucgccugaucgcuaugcuuuauacaccccugagagccaacaacgcuggagaugacguguuuaccgugagcugccggguccucacccgcccuuccccggauuucgacuuuauuuuccuggugcccccuacgguugaaagcagaaccaagcccuuuucugugccuauccuuacagucgaggaaaugaccaauucccgguuccccauuccgcuggagaaacucuuuacaggcccuagcucugccuucgugguucagccccagaacgggcgcuguaccacggauggagugcugcugggcacaacccaacucuccccugucaauaucugcacauucagaggggacgugacccauaucgccggaacccagaacuacacaaugaaucuggcuagccagaacuggaauaacuaugaucccacggaggaaauuccugcgccccuuggcaccccggacuuugucggccggauccagggggugcugacacaaaccacacgcagagacggaucuacccggggccacaaggccacgguuuccacagggagcgugcauuucaccccuaaacucggauccguccaguuuucuaccgauacaagcaaugacuucgagaccggccagaacacacgcuuuacgcccguggggguugugcaagauggauccaccacacaccagaaugaaccccagcaguggguccugccugacuacagcggcagagauucucacaacgugcaucuugcuccggccguggcccccaccuucccuggcgagcaacugcucuuuuuccgguccacaaugcccggguguagcggauacccuaauaugaaccuggacugccugcucccccaggaauggguucagcacuuuuaucaggagucugcuccugcccaaagcgaugucgcgcugcuuagauucgugaaucccgacaccggccgcgugcuguuugaguguaagcuccauaaguccggguacgucacgguggcucacaccggacagcacgaucugguuauuccgccuaacggcuauuuccgguuugacucuugggugaaccaguucuacacacuugcccccauggggaauggcgccggaagacgccgggcucuguga

SEQ ID NO: 28014 - RNA, 1623 nt, Artificial Sequence
  derived and/or modified sequence opt5 from capsid_protein__Norovirus__AAZ31402
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugggccccucccaggugacaauguucccgcauaucauugucgacgugagacaacucgagccugugcugaucccccugcucgauguccggaacaaucuguaucacuacaaccagucuaaugacccuaccauuaaacuuaucgcuaugcuguauacaccccuccgcgccaacaacgcuggggaaguuguguuuaccgugagcugcagaguccugacacggcccuccccugauuucgacuuuauuuuccuugugccgcccaccguugagagccgcacgaagccuuuuaccgugcccauccugacagccgaagagaugaccaauucuagauucccuacaccccucggaaagcuguuuaccggcccguccagcgccuucgucgugcagccucagaacgggcggugugcuacggauggaguucugcucggcacaacccaacugucucccgugaauauuugcacauuccgcggcgacgucacccauaucgcggggacccacgauuacacaaugaaccuugccucccagaauuggaacaauuaugacccuacggaggaaauccccgcuccucugggaacccccgauuuugugggcaaaauucaggggguccucacacagaccacaagaggagacggcagcacccgggggcauaaggccacggugucuacaggauccguucacuucaccccgaagcugggcggcgugcaauuuaccacagacaccaacaaugauuucgagacagggcagaacacgaaauuuaccccugucggagugauccaggacggcaauagcacacaccaaaacgaaccccagcaguggguucuucccaauuacuccgggcgcaccggacauaacgugcaccuggccccugcugucgccccgacauuccccggcgagcagcuccuguuuuucagaucuaccaugccuggguguagcggcuaccccaauaugaaccuggauugccuccugccucaagaaugggugcagcauuuuuaucaggaggcggcucccgcccaguccgacguggcccuucugcgguucguuaacccugaugcuggacgcguccucuuugaguguaagccccacaaaagcggcuacgugacgguggcccacaccgggcaacaugaccuggucauuccgccuaauggauauuucagauuugauucuugggugaaccaguucugcacacuugcucccaugggcaaugggaccggacggagacgcgcccuguga

SEQ ID NO: 28015 - RNA, 1620 nt, Artificial Sequence
  derived and/or modified sequence opt5 from capsid_protein__Norovirus__AAZ31411
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuacccuucucaccucgcucgcauguauaacggguacgccggaggcuucgaaguccaggugauccuggcuggcaaugccuuuacagcggggaaaauuaucuucgccgcuguucccccuaacuuucccacggagggacuuagcccgucccaggugaccauguucccucauaucauugucgacgugagacaacuggaucccgugcucaucccuucucccgacguccggaauaacuuuuaucacuacaaucagagcaacgauuccacaauuaagcugaucgccaugcuguauacaccccuccgcgcuaacaaugccggcgacgauguuuucaccgugagcugcagagugcugacccggccuucuccggacuuugauuucauuuuucuugugcccccuacagucgagucccgcaccaaacccuucacgguuccuauccugaccguggaagagaugagcaacucuagauuucccauuccgcucgaaaagcuguacacagggccuuccagcgccuucgucgugcagccccagaauggacgguguaccacagacggcguucuucuggggaccacgcaacucucugcugugaacaucugcacauuccgcggagaugucacccauaucgcgggcucccacgacuauacaaugaaucuggccagccagaacuggauuaauuacgacccuaccgaggagauccccgcuccucugggcacccccgauuuuguggggaaaauucagggaaugcucacacagacgaccagagaagacggcuccacacgggcccauaaggccaccgucucuacagggagcgugcacuucaccccgaagcugggauccguucaauacacgacagauaccaacaaugacuuucagaccggccaggauacaaaauucaccccugugggggucauccaagacggaaacaaucaccagaacgagccccagcagugggugcuucccaauuauagcggccgcacaggccauaacguucaccuggcuccugccguggcgccgacguuucccggggaacaacuccuguucuuuagaucuaccaugccuggauguuccggcuaccccaauaugaaccuugauugccugcucccucaggaguggguccagcauuucuaucaggaagcugcccccgcccaaccugacguggcucugcugcgguuugugaaccccgauacagggcgcguucucuucgaguguaagcugcacaaaagcggauacgucaccguggcccacacaggcccgcaugaccuugugauuccucccaauggguauuuuagauucgauucuugggucaaccaguuuuacacccuggcuccuaugggcaauggagccggccggagacgcgcgcucuga

SEQ ID NO: 28016 - RNA, 1647 nt, Artificial Sequence
  derived and/or modified sequence opt5 from capsid_protein__Norovirus__AAZ31423
augaagauggccagcuccgacgcuacccccucuaacgauggcgccgcggggcuggugccugagaucgacaaugaagcuauggcccucgauccggucgccggagcugccauugcugcgccccugacaggccagcaaaacaucauugaccuuuggaucaugaauaacuucguucaggccccugggggagaguuuacggugagccccagaaauuccccuggcgaagugcugcucaaccuggagcuugggcccgaaauuaauccuuaccuggcccaccucgcucggaugcauaacggauaugccggcggcuucgagguccaggugguucuggcugggaaugccuuuaccgcgggaaaaaucaucuucgccgcuauuccgcccaacuuuccuaucgauaaucugucugccgcucagauuacaaugugcccccacgugaucgucgacgugcgccaacucgagccuguuaaccugcccaugccggaugugagaaauaacuucuuucauuacaaucagggcagcgacucccggcuucgccugauugccaugcucuauaccccucugagagccaacaacucuggggaugacgucuucacagugagcugucgggugcuuacccgccccuccccugauuuuagcuucaauuuucuggucccucccacaguugaaucuaagaccaaacccuucacgcucccgauccugaccauuuccgagaugagcaacucuagauuucccgugccuaucgacucccugcucacaagccccaccgaaaauaucgugguccagugccagaacggacgggugacacuggauggcgagcuuauggggaccacgcaacugcucccuucucagauuugugcuuuccgcggaguucugacaagauccaccagccgggcguccgaccaggccgacacagcuacaccccgccuuuucaauuacuauuggcacauccagcuggauaaccucaauggcaccccguacgacccugccgaggauauucccggcccucuggggacccccgacuuuagaggaaagguguucggcgucgccucucaacggaacccugauagcacgacccgcgcucaugaagccaaaguggacacaaccgcggggagauuuacacccaagcugggaucccucgagaucagcaccgaaucugaugacuucgaucagaaucagccgacgcgguuuacaccuguuggcauugggguggacagagaggcugauuuccaacaguggucccugcccgacuauagcggacaguuuacccacaacaugaaucuugcccccgccgucgcuccuaaccugccgggcgaacagcuccuguucuuucgcucucaacuucccagcuccggcgggcggucuaccggaauccuggacugccucgugccucaggaguggguccagcacuucuaccaggagagcgcccccgcucaaacacagguggcccugguuagauacaucaauccugauaccggccgcgugcuguuugaagcgaagcuccauaaacugggguucaugacaauugccaagaacggagacucccccaucacggucccucccaauggcuauuuucgguucgagagcugggugaacccguucuacacccuugcuccuauggggacaggcucuggaagacgccggauucaguga

SEQ ID NO: 28017 - RNA, 1623 nt, Artificial Sequence
  derived and/or modified sequence opt5 from capsid_protein__Norovirus__AAZ31428
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagcccccgcaauuccccuggagagauccuucuggaucucgaacugggcccggagcuuaaccccuaccuggcccaccucgcgcggauguauaaugggcauccuucuggaauggaggaacagauuguucuggccggcaacgcuuucacggccggcaaaaucaucuuugcugccauucccccuggguuccccuacgagaaucugagcccgucccacaugaccaugugcccucaugugaucauuuaugucauccagcucgaacccgugcugaugcuuaugccugagauucaaaacaacuuuuuccacuacaaucagggaaaugaccccaagcugagacucguugcgaugcuguauacaccccuucgggccaacaacucuggcgaugacguguuuaccgucagcugucgcgugcugacaaaaccuuccccggauuucgaguuuaccuuccucgugcccccuacagucgaaagcaagaccaaagaguuuacgcugcccauccugagaauuucugaaaugaccaauucccgguucccuguucccguggagaugauguacacagcucgcaacgaaaaucaggugguccagccgcaaaacgggagagugacccucgacggagagcugcuuggcacaaccccucugcucgccguuaauaucugcaaguuuaagggggaggugaucgcuaaaaacggagauguccggagcuaucgcauggacauggaaauuacgaauacagauggcacccccaucgacccuacagaggauacccccggcccuauugggucucccgacuuccagggaauccuguucggcguggccucccagagaaacaagaaugaacagaacccggccacccgggcucaugagguuaauauuaacacagggggagaccaauacgcgccuaaacuugcccaggugaaguuuuucagcgaaucucaggauuuugagguccaccaacccacgguguucacccccgucggcguggcuggggacacaucccacccuuuucgccaguggguucugccgagauacggaggccaucucaccaauaacacacaccuggcccccgccguggcuccucuguuccccggcgagcagauccucuuuuuccggagccagaucccuuccucugggggacaugaacugggcuauauggauugucuugucccccaagagugggugcagcacuuuuaccaggaagccgcgaccgcucagagcgagguugcccugauucgcuucaucaauccugacacggggagagugcucuuugaagccaaacugcacaagcaaggauucauuacagucgcucauaccggcgauaaccccaucgugaugccgccuaacggguauuuucgguucgaggccugggugaaucaguucuacucccuugcucccguuggcaccggaaacggcagacgccggguccaguga

SEQ ID NO: 28018 - RNA, 1626 nt, Artificial Sequence
  derived and/or modified sequence opt5 from capsid_protein__Norovirus__ABB02420
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggacaggacaagucgcuaccuucacaaugauugagcaggacggcucugccuacgugcccggggaucgggcggcuccucugggauaccccgacuauuccggccagcuggaaaucgagguccagaccgaaaccacaaaggccggggacaaacucaaggugacgaccuuugagaugauucugggaccuacaaccaauguugaucaagcccccuaccagggccgcgcuuaugccagccuuacagcuguggccucccuggaccucgucgauggcagagugcgggcgguuccgcgcucuaucuacagcuuccaggacgugcugccugaauauaacgaugggcuucuggucccccucgcucccccucugggaccguuccugcccggcgaggugcuccugagauuucggaccuacaugagacagcuugacacggccgaugccgcugcccaaccuauugacugcgcgcugccccaggaguucaucuccugguuugccagcaauucuuucacagugcaguccgaugcucuccugguucgcuaucggaacacccugaccgggcagcuucucuuugaagccaagcuguacagcgagggauacaucgcugucucuuauagcggcuccgggccucugacauuccccaccgacggcuuuuucgaaguggugucuugggucccuagacucuuucaacuggccagcgugggaucccuugccacaggccgcacgcugaaacaguga

SEQ ID NO: 28019 - RNA, 1626 nt, Artificial Sequence
  derived and/or modified sequence opt5 from capsid_protein__Norovirus__ABB02423
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccucugacuucaacuuuguguaccucacacccccuauugagcgcaccaucuauagaauggucgaucugccggugcuucagccccggcugugcacccaugcccgcuggccugcucccguuuacggccuccugguggacccuucccuucccagcaauccgcaauggcagaacgggagaguccacguggauggaacacugcucggcaccacgccuguuucuggcuccugggugagcuguuucgcggccgaagcugccuaugaguuucagucugggacaggagaggucgccaccuucacaaugauugaacaagacggcuccgcuuacgugcccggggaucgggccgcgccucugggauaccccgacuuuagcggccagcuggagaucgaaguccagaccgagaccacaaagacgggggacaaacucaaggugaccacauucgaaaugauucugggaccuaccacaaauguugaucaggcucccuaucaaggccgcgccuacgccucccuuaccgcugccgcuucucuggaccucguggauggcagaguccgggccgugccgcgcagcguuuauuccuuccaggacgagcugccugaguacaacgaugggcuucuggugccccucgcgcccccucugggaccguuucugcccggcgaaguccuccugagauuccggacguauaugagacagcuugacacagccgaugcuagcgcccagccuaucgacugcgcucugccccaagaguuuauuucuugguucgccuccaauaacuuuaccgugcagagcgaugcgcuccuggugcgcuaccggaauacccugacagggcagcuucucuucgaagccaagcuguauucugagggauacaucgcuguuagcuacuccggcucugggccucugaccuuucccacagacggcuucuuugaagucgugagcugggugccuagacucuuccagcuggccuccgucggaagccuugugacgggccgcacccugaaacaauga

SEQ ID NO: 28020 - RNA, 1623 nt, Artificial Sequence
  derived and/or modified sequence opt5 from capsid_protein__Norovirus__ABC96746
augaagauggccagcaacgacgcuuccucuagcgauggcuccaccgccaaucuggugcccgaggucaacaaugaaguuauggcgcucgagccuguggugggggcugccaucgccgcuccggucgccggacagcaaaacgugauugaccccuggaucagaaauaacuucguucaggcuccuggcggggaauuuacagugucuccccggaaugccccuggagagauucuguggagcgcgccccuuggcccugaucugaacccguaccucucccaccuggcccgcauguauaauggguacgcuggaggcuucgaaguccaggugauccuugccggcaacgcuuuuacggccgggaaaauuaucuucgcggccguucccccuaauuuucccaccgagggacugucuccuagccaggugacaauguucccccauaucauugucgacgugagacaacucgagccggugcugaucccucugcccgauguccggaacaauuuuuaucacuacaaccaguccaaugacccuaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccacgauuacacaaugaaccucgcuucucagaauuggaacaauuaugacccuacggaggaaauucccgcgccucugggcacccccgacuucguggggaaaauccagggaguccuuacacagaccacaagaggcgauggguccacccggggacauaaggccacggugagcacaggcuccguucacuuuaccccgaagcuggggucugugcaauucaccacagacaccaacaaugauuuugagacaggacagaacacgaaauucaccccugucggcgugguucaggacggcaauagcacacaccaaaacgaaccccagcagugggugcuccccaauuacuccgggcgcaccggacauaacguccaccuggcuccugccguggccccgacauuucccggcgagcagcuucuguucuuuagaagcaccaugccuggguguucuggauaccccaauaugaaccucgauugccugcugccucaagaaugggugcagcauuucuaucaggaggcugcccccgcgcaguccgacguugcucuccugcgguuugucaacccugauacgggccgcgugcuuuucgaguguaagcugcacaaaagcggguacgugaccgucgcccacacaggccaacaugaccucgugauucccccgaauggauauuuuagauucgauucuuggguuaaccaguucuacacccuggccccuaugggcaauggggcuggacggagacgcgcccuuuga

SEQ ID NO: 28021 - RNA, 1620 nt, Artificial Sequence
  derived and/or modified sequence opt5 from capsid_protein__Norovirus__ABD77588
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauuccucuguucaggcucccggcggggaguucacagugagcccucgggaugcccccggagaaauucugugguccgcgccucuuggcccggaccugaaccccuaccucucucaccuggcccgcauguauaauggguacgcuggaggcuuugaaguccaggugauccuugccggcaacgcuuucacggccgggaaaauuaucuuugcggccgcuccucccaauuucccuaccgagggacugagccccucccagguuacaauguuuccgcauaucauugugggcgucagacaacucgagccugugcugaucccccugccugaugugcggaacaauuucuaucacuacaaccagagcaaugacucuaccauuaagcucaucgccaugcuguauacaccccuucgcgcuaacaaugccggggaugacgucuuuaccguuuccugcagagugcugacacggcccagcccugauuucgacuuuauuuuccucgugccgcccaccgucgaaucucgcacgaaaccuuuuaccgugcccauccugacaguugaggaaaugaccaacuccagauucccuauuccccuugagaacuguagccgggugccggccgucccucugucuuccaaucauaagaugcagugcacaaccgauggagugcuccugggcacgacacagcugagccccguuaacaucuguaccuuucgcggggacgugacacacaucccuggaaccagaaccuaccggaugaaucucgcuucccaaaacuggaauaacuaugaucccacagaggaaauuccugcgccccugggcacgccggacuucgucggcaaaauccaggggaugcuuacccagacaaccaagggagacggcucuacacgcgggcauaaggccaccgugagcacgggauccgucgauuucacaccuaaacugggcagcgugcaguuugcuaccgacaccgauaaugacuucgagacagggcaaaacaccagauuuacacccguuggagugauucaggaugggucuuccacgcaccggaaugaaccccagcaauggguccucccugacuacagcggccgcaccgugcacaacguucaucuggccccggccguggcucccacauucccuggcgagcagcuucuguuuuucagaucuaccaugcccggaugcagcggcuacccuaauauggaucucgacugucugcugccccaggaauggguccagcacuuuuaucaagaggccgcgccuucccagucugauguggcucuccugcgguucgugaaccccgacacagggagaguucuuuuugagugcaagcugcauaaagccggauacgucaccguggcccacacgggccagcacgaucucgugaucccgccuaauggguauuuccgcuuugacagcugggucaaccaguucuacacccuggcucccaugggcaauggagccggccggagacgcgcucuuuga

SEQ ID NO: 28022 - RNA, 1623 nt, Artificial Sequence
  derived and/or modified sequence opt5 from capsid_protein__Norovirus__ABD77589
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggacucuguucaauucgccaccgauacagacaacgauuuugagaccgggcagaauacaagauucacgcccgugggagucauucaggacggcagcuccgcucaucggaacgaaccccaacagugggugcucccugauuacagcggccgcaccguucacaaugugcaccuggccccggccgucgcucccacauuuccuggggagcagcuucuguucuuuagaucuaccaugcccggauguuccggcuacccuaacauggaccucgauugccugcugccccaggaaugggugcaacauuucuaucaggaggccgcgccuagccagucugacguggcucuccugcgguuuguuaaucccgauacagggagaguccuuuucgaguguaagcugcacaaagccggauacgugaccguggcccauacgggccagcacgaccucgucaucccgccuaacggguauuuucgcuucgacagcugggugaaucaauucuacacccuggcucccaugggcaacggagccggccggagacgcgcucuuuga

SEQ ID NO: 28023 - RNA, 1647 nt, Artificial Sequence
  derived and/or modified sequence opt5 from capsid_protein__Norovirus__ABD77590
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagcaagcugcggcuugucgccaugcuguacacaccccuccgcgccaauaacuccggggacgauguguucaccgugucuuguagaguccugacccggccuagccccgacuuuuccuucaauuuucuuguucccccuacaguggaaagcaaaaccaagccguucacgcugcccauucucaccaucucugagauguccaacagccgcuuuccugugcccauugauucucugcauacauccccuaccgaaaauaucagcguccagugccagaacggaagagugacacuggacggcgagcucauggggaccacgcaacugcuucccucucagaucugugcuuuccggggaguucugacacgcuccaccagcagagcguccgaucaggccgacacagcuaccccgagacucuucaauuauuacuggcacauucagcuggacaaccuuaauggcaccccuuaugaucccgccgaggacaucccuggcccccuggggacaccugauuuucgcggaaaaguguucggcgucgccucucaaagaaaccccgacagcacgacccgggcucaugaagccaagguggauacaaccgcggggcgcuuuacaccgaagcucggaucccuggagauuagcaccgaaucuggcgacuucgaucagaaucagccuacgagauuuacacccguugggaucggaguggaccacgaggaaaacuuccaacaguggucccugcccgauuacagcggccaguuuacccacaauaugaaccucgcuccugccgucgccccgaauuuccccggcgagcagcugcuguuuuuccggucucaacuuccuagcuccgggggaagaucuaacggcauucucgacugccuggugccccaggaguggguccagcauuuuuaccaggaaagcgcuccugcccaaacccagguggcucuuguucgcuaugugaaccccgauacagggcggguccuguucgaggccaaacuccacaagcugggauuuaugaccaucgcgaaaaauggcgacuccccuaucacagugcccccgaacggguacuucagauucgaaagcuggguuaauccuuuuuauacgcuggcccccaugggcaccggaaacggccgccggcggauucaguga

SEQ ID NO: 28024 - RNA, 1626 nt, Artificial Sequence
  derived and/or modified sequence opt5 from capsid_protein__Norovirus__ABG45845
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggugcuucagccccggcugugcacccaugcccgcuggccugcucccauuuacggccuccugguugacccuucccuucccgcgaauccgcaauggcagaacgggagagugcacgucgauggaacacugcucggcaccacgccugugagcggcucuuggguuuccuguuucgccgcugaagccgccuaugaguuucagagcgggacaggagagguggcuaccuucacacugaucgaacaagacggcucugccuacguccccggggaucgggcggcuccucugggauaccccgacuuuuccggccagcucgagauugaagugcagaccgagaccacaaagacgggggacaaacugaccgucacaaccuucgaaaugauccuuggaccuacaaccaauguggaucaggcccccuuccaaggccgcgccuaugcuagccugacggccgcugccucccucgaccugguugauggcagagugcgggcggucccgcgcucuauuuacagcuuucaggacgugaucccugaguauaacgaugggcuucugguuccccucgcucccccuaucggaccguuccugcccggcgaggugcugcucagauuucggacauacaugagacagauugacuccagcgaugccgccgcugaagccaucgacugcgcgcugccucaggaguucauuucuugguuugccuccaaugcuuucaccguccaaagcgaagcccuucugcuccgcuaucggaacacccugacagggcagcugcuuuuugaguguaagcucuacucugaaggauauaucgcucugagcuacuccggcucugggccccugaccuucccuacagauggcuuuuucgagguggugagcuggguucccagacucuaccagcuggccuccgucggaagccuugccacgggccgcacccugaagcaguga

SEQ ID NO: 28025 - RNA, 1626 nt, Artificial Sequence
  derived and/or modified sequence opt5 from capsid_protein__Norovirus__ABG45847
augagaaugagcgacggcgccgcucccaaggccaacggguccgaggcgucuggacaggaucuggugccuaccgcucucgaacaagccgucccgauccagcccguugccggcgcuagccuggccgcuccugccgcggggcagauuaaucagaucgaccccuggauuuuccaaaacuuugugcagugcccucuuggagaguucuccaucucuccccggaauacaccuggcgaaauucuguuugaucucgcccuggggccgggacuuaaccccuaccuggcucaccucagcgccauguauacgggcugggugggcaauauggagguccagcuggugcuggcugggaacgccuucaccgcgggaaaaguuguggucgcccucgugccucccuacuuuccuaagggcucccugacaaccgcucagaucacauguuucccccauguuaugugcgacgugcgcacccuugaaccgauccaacugccucuccuggaugucagacgggugcuuuggcacgccacacaggaccaggaggagucuaugcgccugguguguaugcucuauacgccccugagaaccaauagcccuggggaugaauccuuugucguuagcggacggcugcucucuaaacccgcugccgacuucaacuuuguguaccugacacccccuauugagcgcaccaucuauagaaugguggaucuuccgguccugcagccccggcucugcacccaugcccgcuggccugcucccauuuacggccugcuuguggacccuucccugcccgcgaauccgcaauggcagaacgggagaguucacguggauggaacacuccugggcaccacgccugucagcggcucuuggguguccuguuucgccgcugaagccgccuaugaguuucagagcgggacaggagagguugcugccuucacccugaucgaacaagacggcucugcguacgugcccggggaucgggcugccccucucggauaccccgacuuuuccggccagcuggagauugaaguccagacagagaccaccaagacaggggacaaacuuacggugaccacauucgaaaugauccugggaccuaccacaaaugucgaucaggcccccuuccaaggccgcguguaugcuagccucaccgccgcugccucccuggaccuuguugauggcagagugcgggcggucccgcgcucuauuuacggguuucaggacgugaucccugaguauaacgauggacugcucguuccccuggcucccccuaucggcccguuccugcccggggaggugcuccugagauuucggacguacaugagacagauugacagcuccgaugccgccgcugaagccaucgacugcgcgcuuccucaggaguucauuagcugguuugccucuaaugcuuucacaguccaauccgaagcccugcuccugcgcuaucggaacacccugaccggacagcuucucuuugaguguaagcuguacagcgaaggcuauaucgcucugucuuacagcggguccggcccccucacauucccuaccgauggauuuuucgagguggugucuuggguucccagacuguaccagcuugccagcgucggcucccuggccacagggcgcacgcucaagcaguga

SEQ ID NO: 28026 - RNA, 1626 nt, Artificial Sequence
  derived and/or modified sequence opt5 from capsid_protein__Norovirus__ABG45849
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccucgcggcucccucacaaccgcucagaucacauguuucccccaugugaugugcgacgucagaacccuggaaccgauccaacuuccucugcucgaugugcggcgcgugcuguggcacgccacacaggaccaggaggagucuaugagacuugucuguaugcuguauacgccccuccggaccaauagcccuggggaugaauccuuuguugugagcggacgccugcugucuaagcccgcugccgacuucaacuuuguguaccucacacccccuauugagagaaccaucuaucggauggucgaucugccggugcuucagccccgccugugcacccaugccagauggccugcucccauuuacggccuccugguugggccuucccuucccgcgaauccgcaauggcagaacggacgggugcacgucgacggcacacugcucggcaccacgccugugagcgggucuuggguuuccuguuucgccgcugaagccgccuaugaguuucagagcggaacaggcgagguggcugccuucacccugaucgaacaagaugggucugcguacguccccggagaccgcgcugccccucugggcuaccccgauuuuuccgggcagcucgagauugaagugcagacagagaccaccaaaacaggagacaagcugacggucaccacauucgaaaugauccuuggcccuaccacaaauguggaccaggcccccuuccaaggcagaguuuaugcuagccugaccgccgcugccucccucgaucugguggacgggcggguccgcgcggugccgagaucuauuuacggauuucaggauguuaucccugaguauaacgacggccuucuggugccccucgcucccccuaucgggccguuccugcccggagagguccugcuccgguuuagaacguacaugcgccagauugauagcuccgacgccgccgcugaagccaucgauugcgcgcugccucaggaguucauuagcugguuugccucuaaugcuuucacagugcaauccgaagcccuucugcuccgguauagaaacacccugaccgagcagcugcuuuuugaauguaaacucuacagcgagggcuauaucgcucugucuuacagcggguccggcccccugacauucccuaccgacggauuuuucgaggccgugucuuggguuccccgccucuaccagcuggccagcgucggcucccuugcuacagggcggacgcugaagcaguga

SEQ ID NO: 28027 - RNA, 1626 nt, Artificial Sequence
  derived and/or modified sequence opt5 from capsid_protein__Norovirus__ABG45851
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggccgucgcucuggugccucccuacuuuccuaagggcucccucacaaccgcccagaucacauguuucccccauguuaugugcgacgugcgcacccuggaaccgauccaacuuccucugcucgaugucagacgggugcuguggcacgcuacacaggaccaggaggagucuaugcgccuuguguguaugcuguauacgccccucagaaccaauagcccuggggaugaauccuuugucguuagcggacggcugcugucuaaacccgccgccgacuucaacuuuguguaccucacacccccuauugagcgcaccaucuauagaaugguggaucugccgguccuucagccccggcugugcacccaugcucgcuggccugcgcccauuuacggccuccugguggacccuucccuucccgccaauccgcaauggcagaacgggagaguucacguggauggaacacugcucggcaccacgccugucagcggcucucggguguccuguuucgcugccgaagccgcuuaugaguuucagagcgggacaggagagguugccaccuucacacugaucgaacaagacggcucugcguacgugcccggggaucgcgcugccccucugggauaccccgacuuuuccggccagcucgagauugaaguccagaccgagaccacaaagacgggggacaaacugaccgugacaaccuucgaaaugauccuuggaccuacaaccaaugucgaucaggcccccuuccaaggcagagcuuaugccagccugacggcugccgcgucccucgaccugguggauggccggguucgcgccgugccgagaucuauuuacagcuuucaggacgucaucccugaguauaacgaugggcuucuggugccccucgcucccccuaucggaccguuccugcccggcgagguucugcuccgguuuagaacauacaugcgccagauugacuccagcgaugccgcugccgaagcgaucgacugcgcccugccucaggaguucauuucuugguuugcuuccaaugccuucaccgugcaaagcgaagcccuucugcuccgguauagaaacacccugacagggcagcugcuuuuugaguguaagcucuacucugaaggauauaucgcucugagcuacuccggcucugggccccugaccuucccuacagauggcuuuuucgaggucgugagcugggugccccgccucuaccagcuggccuccguuggaagccuugcuacgggccggacccugaagcaguga

SEQ ID NO: 28028 - RNA, 1626 nt, Artificial Sequence
  derived and/or modified sequence opt5 from capsid_protein__Norovirus__ABI95835
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggugcuucagccccggcugugcacccaugcccgcuggccugcucccauuuacggccuccugguugacccuucccuucccgcgaauccgcaauggcagaacgggagagugcacgucgauggaacacugcucggcaccacgccugugagcggcucuuggguuuccuguuucgccgcugaagccgccuaugaguuucagagcgggacaggagagguggcuaccuucacacugaucgaacaagacggcucugccuacguccccggggaucgggcggcuccucugggauaccccgacuuuuccggccagcucgagauugaagugcagaccgagaccacaaagacgggggacaaacugaccgucacaaccuucgaaaugauccuuggaccuacaaccaauguggaucaggcccccuuccaaggccgcgccuaugcuagccugacggccgcugccucccucgaccugguugauggcagagugcgggcggucccgcgcucuauuuacagcuuucaggacgugaucccugaguauaacgaugggcuucugguuccccucgcucccccuaucggaccguuccugcccggcgaggugcugcucagauuucggacauacaugagacagauugacuccagcgaugccgccgcugaagccaucgacugcgcgcugccucaggaguucauuucuugguuugccuccaaugcuuucaccguccaaagcgaagcccuucugcuccgcuaucggaacacccugacagggcagcugcuuuuugaguguaagcucuacucugaaggauauaucgcucugagcuacuccggcucugggccccugauuuucccuaccgauggcuuuuucgagguggugagcuggguucccagacucuaccagcuggccuccgucggaagccuugccacaggccgcacgcugaagcaguga

SEQ ID NO: 28029 - RNA, 1620 nt, Artificial Sequence
  derived and/or modified sequence opt5 from capsid_protein__Norovirus__ABI97981
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcacguauaacggguacgcuggaggcuucgaaguccaggugauccuugccggcaaugcuuuuaccgccgggaaaauuaucuucgcggccguuccucccaacuuuccuacagagggacugagccccucccaggugaccauguucccgcauaucauugucgacgugagacaacucgagccugugcugaucccccugccugauguccggaauaacuuuuaucacuacaaucagucuaacgacagcacaauuaagcucaucgcuaugcuguauacaccccuucgcgccaacaaugcuggcgaugacguuuucaccguguccugcagagugcugacccggcccagcccugauuuugacuucauuuuucucgucccgcccacgguggaaucucgcaccaaaccuuucacaguucccauccugaccguggaggaaauguccaacagcagauuuccuauuccccuugagaagcuguacacagggccgucuuccgccuucgucgugcagccucagaauggacgguguaccacggauggcguucuccuggggacaacccaacugagcgccgugaacaucugcacauuccgcggagacgucacccauaucgcuggcucucacgauuauaccaugaaucucgcgucccagaacuggaauaacuacgaccccacagaggaaauuccugcuccccugggcacgccugacuuuguggggaaaauccagggaaugcuuacccagacaaccagagaggauggcagcacacgggcccauaaggccaccgucuccacggggucugugcacuucacacccaagcugggaagcguucaauacaccaccgacacaaauaacgauuuucagaccggccagaauacaaaauucacgccggugggggucauucaagacggaaacaaucaccagaacgaaccucagcagugggugcuccccaauuauuccggccgcaccggccauaacguucaccuggcccccgcuguggccccuacauuuccgggggagcaacuucuguucuuuagaagcaccaugcccggauguucuggcuacccuaacaugaaucucgauugccugcugccccaggaauggguccagcauuucuaucaggaggcggcuccugcccaauccgacguggcccuccugcgguuugugaaccccgauacagggcgcguucuuuucgaguguaagcugcacaaaagcggauacgucaccguggcucacacgggcccucaugaccucgugauucccccgaauggguauuuuagauucgauucuugggucaaccaguuuuacacccuggccccuaugggcaauggagcuggccggagacgcgcccuuuga

SEQ ID NO: 28030 - RNA, 1626 nt, Artificial Sequence
  derived and/or modified sequence opt5 from capsid_protein__Norovirus__ABP99038
augagaaugagcgacggcgccgcucccaaggccaacggguccgaggcgucuggacaggaucuggugccuaccgcugucgaacaagccguuccgauccagcccguggccggcgcuagccucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggcccuucagccccggcugugcacccaugcucgcuggccugcgcccguguacggccuccugguugacccuucccuucccagcucuccgcaauggcagaaugggagagugcacgucgauggaacacugcucggcaccacgccuguguccggcagcuggguuucuuguuucgccgcugaagccgccuaugaguuucaguccgggacaggagagguggcuaccagcacacugauugaacaagacggcuccgccuacguccccggggagcgggcggcuccucugggauaccccgauuucucuggccagcucgaaaucgaggugcagaccgaaaccacaaaggccggggacaaacugcgcgucacgaccuuugagaugauucuuggaccuacaaccaacguggaccaggcccccuaucaaggcagaguuuacgcuagccugacagccgcugccucccucgaucugguggacggccggguccgcgcggugccgagaagcaucuauggguuccaggauguuauuccugaguacaaugacggacuucuggugccccucgcucccccuaucggcccguuccugcccggggaaguccugcuccgguuuagaaccuauaugcgccagaucgauucuuccgacgccgccgcugaggccauugauugcgcgcugccucaggaguucaucagcugguuugccucuaacgcuuucacggugcaaagcgaagcccuucugcuccgguacagaaauacacugaccggacagcugcuuuuugaauguaagcucuauuccgagggcuacauugcucugucuuacagcggguccggcccccuggccuucccuaccgacggauuuuucgaggugguuagcugggucccccgccucuaucagcuggccucugugggcucccuugcuacagggcggacccugaagcaguga

SEQ ID NO: 28031 - RNA, 1626 nt, Artificial Sequence
  derived and/or modified sequence opt5 from capsid_protein__Norovirus__ABP99041
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggacaggagaggucgcuaccuucacaaugauugaacaagacggcucugccuacgugcccggggaucgggcggcuccucugggauaccccgacuuuuccggccagcuggagaucgaaguccagaccgagaccacaaaggccggggacaaacucaaggugacgaccuucgauaugauucugggaccuacaaccaauguugaccaggcccccuaucaaggccgcgcuuacgccagccuuacagcugccgcgucccuggaucucguggacggcagaguccgggccgugccgcgcucuaucuauagcuuccaggaugaacugccugaguacaacgacgggcuucugguuccccucgcucccccucugggaccguuucugcccggcgaggugcuccugagauuccggaccuauaugagacagcuugauacggccgacgcuuccgcccagccuauugauugcgcgcugccccaagaauuuaucagcugguucgccucuaauaacuuuacaguccaguccgacgcucuccuggugcgcuaccggaauacccugaccgggcagcuucucuucgaggccaagcuguauagcgaaggauacaucgcugugucuuacagcggcuccgggccucugacauuucccaccgauggcuucuuugagguugucucuugggugccuagacucuuccagcuggccagcgugggaucccuugccacaggccgcacgcugaaacaauga

SEQ ID NO: 28032 - RNA, 1623 nt, Artificial Sequence
  derived and/or modified sequence opt5 from capsid_protein__Norovirus__ABQ12784
augaagauggccagcaacgacgcuacccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuacagugagcccucggaaugcgcccggagagauucugugguccgccccucuuggcccggaucugaaccccuaccucucucaccuggcucgcauguauaauggguacgccggaggcuucgaaguccaggugauccuugcuggcaacgccuuuacggcggggaaaauuaucuucgccgcuguuccucccaauuuuccuaccgagggacugagccccucccaggugacaauguucccgcauaucauugucgacgugagacaacucgagccugugcugaucccccugccugauguccggaacaauuuuuaucacuacaaccagucuaaugaccccaccauuaagcucaucgccaugcuguauacaccccuucgcgcuaacaacgccggcgaugacguuuucaccgugagcugcagagugcugacacggccuuccccggauuuugacuucauuuuucucgugcccccuaccgucgaaagccgcacgaaacccuucucuguuccuauccugaccguggaggaaaugacaaauuccagauuucccauuccgcuugagaagcuguucaccgggccuucuagcuccuucgucgugcagccccagaacggacgguguacaaccgauggcguucuccuggggacgacacaacugagcccugugaauaucugcaccuuucgcggagacgucacacauaucgccggcacccagaacuacaccaugaaucucgcuucucagaacuggaauaacuaugaucccacagaggaaauuccugcgccccugggcacgccggacuucguggggaaaauccagggaguccuuacccaaacaaccagacgggacggcuccacacgcgggcacaaggccaccgugagcacgggauccguucauuuuacaccuaagcugggcucugugcaguucagcaccgauaccuccaaugacuuugagacagggcagaacaccagauucacacccgucggagugguucaagauggcagcacgacaccccagaaugaaccucagcagugggugcucccggacuacucuggccgggauucccacaacguccaccuggcucccgccguggccccuaccuuucccggggagcaacuucuguucuuucgcagcaccaugccuggauguucuggcuaccccaauaugaaccucgacugccugcugccucaggaaugggugcagcauuucuaucaggagagcgcucccgcccaauccgauguugcgcuccugagauuugucaauccggacacagggcgggugcuuuucgaguguaaacugcacaagucuggauacgugaccgucgcucauacgggccagcacgaucucgugauuccucccaacggguauuuuagauucgacagcuggguuaaccaguucuacacccuggccccuaugggcaauggagccggccgccggagagcucuuuga

SEQ ID NO: 28033 - RNA, 1737 nt, Artificial Sequence
  derived and/or modified sequence opt5 from capsid_protein__Norovirus__ABR15783
augaagauggccagcuccgacgcuacccccucuagcgauggcgccgggaaccuggugccugagucccagcaagaaguccucccgcuggcgcccguugcuggagccgcccuugcugccccuguggugggccagcagaauaucauugaccccuggaucaaagagaacuucguccaggcuccucaaggggaauuuacagugucucccaagaauagcccuggagagguucuggugaaccucgaacuguccccgagacuuaaucccuaccugcaccaucucucuaaaauguauaacgccuacgcgggcgggauggaggucgagauuauccuggccggaaaugcuuucacggccggcaaggugcugauugcugccguuccucccaacuuuccuaucgaaaaugugagcgcgucccaggccagccaguucccccacgucaucguggaugugcggacccucgagccgauucgccugccucuucccgacgucagaacaaacuuuuuccauuauaccacacaggaagaaccucggaugcgcaucguugcuuggcuguacacaccccucagaaccaauggcucuggggaugacuccuuuaccgugagcggacggauucugacgcgccccucuccugauuucgaguuuuccuuccuugugccgcccaccgucgaaacaaaaaccgugagcuuuucuguuccuggccuggugguccaagacauguccaacagcagauggcccgcccagaucuccgggcucgugguucggggaaaugaggcucaggugguccacuuccagaacggccgcugcacaaccgaagggaugcugcugggaacgacaacccucaauauuaacucuaucuguggccugagaggccuuagcgugucccaagccagcguccgcggggccccugcucugacagaggaaaugcccccgcucgaggaugagguggcggacggagccgcugccaccuauacccugacacgggccgcugauacggcccuuuggcugagaguugaggagccugacggccggcccuacgauauuuuuggggaccagccugcgccccucggaaccccugacuucacagcugugaucgucggcaccgccauccgccccagaacaaccucuggggccuaucugcaugaugcuuacguggacacgacaccgggagaugccgacuucaccccuuccaccggcaacacaaagauuguucugcggggcgggggaagcggccacguggggcagggacacuacuggcaauuuaagcccaucgcugucgaaggcgggggcucuagaccccaguaucaggaguacaaucucccugauuaugccggaccgaccgcgagcaaccaugaccuggccccucccguggcuccccgcaugccuggcgaacuucugcuccuguucgaguccgauaugcccgugugggacaauggggccggagcugccccugcgcagaaaauucacugccuucugcccaacgaguuuaucacacaucucuucgaucugcaagccccggcucuggccgaagcugcccuccugcgguacguucacccugacucuggcagaacgcuuuuugaguguaagcuguaucgcgaaggguacauggucguggccgcucccgugggacggcucaauuucccucuggauggcuauuuuagauucgacagcugggucuccgcguuuuacgugcugagccccguugggucuggccagggacgccggggcagauccaaagccgcuuga

SEQ ID NO: 28034 - RNA, 807 nt, Artificial Sequence
  derived and/or modified sequence opt5 from capsid_protein__Norovirus__ABR24136
auggccggcgcuuucuuugccgggcuggcgagcgacgugcucggauccggccuggggucucuuaucaacgcuggagccggcgccauuaaucagaaggucgaguucgaaaacaauagaaaacugcaacaggcuagcuuugaguucuccucuaaccuccagcaggccagcuuucaacacgauaaggaaaugcugcaggcucagaucgaggccaccaaaaagcugcagcaagggaugaugaaaguuaagcaggcgaugcuucucgaaggaggcuucuccgagacagacgccgcucggggcgccauuaaugcucccaugacgaaggcccuggauuggucugggacccgcuacugggcgccugacgccagaacaaccacauauaacgcuggacgguuuagcaccccgcagcccuccggcgcccugccugggcgcacaaaucccagagcuaccgugccugcccggggaagccccucuacgccuuccaacaccagcacagugaccucugucuacuccgaucagacagugagcacccgccucggcucuacggccggguccggaacaagaguuagcucccugccgucuaccgcucggacacgcagcuggguggaggaccaaaauagaaaccuuucccccuucaugcggggcgcgcauaauaucagcuuugucaccccucccgccucucgcuccagcucucagggcaccgugagcacaguuccuaaagaagugcuggauuccuggacgggggcuuucaacaccagacggcagccccucuuugcccacauucgcaagagaggagagucucgggccuga

SEQ ID NO: 28035 - RNA, 1647 nt, Artificial Sequence
  derived and/or modified sequence opt5 from capsid_protein__Norovirus__ABS12173
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaccgaaaauaucgugguccagugccagaacggacgggugacacuggacggcgagcucauggggaccacgcaacugcuucccagccagauuugugcuuuccgcggaguucugacaagaucuaccucccggccgagcgaucaggcggacacagccaccccucgccucuucaauuauuacuggcacauccagcuggacaaccuuaauggcacccccuaugauccugcugaggacauucccggcccucuggggacacccgauuuuagaggaaagguguucggcgucgccucccaacggaacccggacucuacgacccgcgcccaugaagcuaaaguggauacaaccgccgggagauuuacaccuaagcucggaagccuggagaucuccaccgaaagcggcgacuucgaucagaaucagcccacgcgguuuacacccguugggauuggaguggaccacgaggcggauuuccaacaguggucucugccugacuacuccggccaguuuacccacaacaugaaucucgcuccggccgucgcccccaacuucccuggcgaacagcugcuguuuuucagaagccaacuucccucuagcgggggacgcuccaauggcauccucgauugccuggugccucaggaguggguccagcauuuuuaccaggagucugcucccgcccaaacccagguggcucuuguucgguaugugaacccugacacagggagaguccuguucgaagccaagcuccacaaacugggauuuaugaccaucgcgaagaacggcgacagccccauuacagugccgccuaauggguacuuccgcuucgaguccuggguuaaccccuuuuauacgcuggccccuaugggcaccggaaauggccggagacgcauccaguga

SEQ ID NO: 28036 - RNA, 1611 nt, Artificial Sequence
  derived and/or modified sequence opt5 from capsid_protein__Norovirus__ABS12175
augaagauggccagcaacgacgcuacccccuccgaugacggcgccgcggggcuggugccugagaucaauucugaagucauggcucucgagccgguugccggagccagccuggcugcccccguggugggccagcaaaacauuaucgauccuuggauuagaaauaacuucguccaggcucccgccggggaauuuacaguguccccucgcaauucucccggagagcuucugcucgaccuggaacuuggcccugagcugaacccguaccucgcgcaccuggcccggauguauaaugggcaugcuggaggcauggagguucagaucgugcuggccggcaacgcuuucacggccgggaaaauucucuuugcggccauucccccuagcuuccccuacgaaaaucuguccccugcucagcuuaccaugugcccccacgucaucguggauguuagacaacuggagccggugcuccugccuaugcccgacauccggaacgucuuuuaucauuacaaucagaacaauucuccuaaacuucgccugguggccaugcucuauacaccccugagagcuaacaauagcggagaugacguguucaccgucuccugucggguucugacacgccccagcccugauuuucaguucaccuuucucgugccgcccacaguggaaucuaagaccaagaacuucacgcugccuguccuuagaguguccgagaugaccaacagccgguuucccguugugcuggaccagauguacacaucucgcaaugagaacaucauuguccaaccucagaauggcagaugcaccacagauggggaacuccugggaaccacgauccuucaguccgugagcauuuguaacuucaaaggcacaaugcaggccaagcugaaugaggaaccccgguaucaacuccagcugaccaaccuggacgggucuccgaucgauccuacagacgacaugcccgccccucucggaacccccgauuuucaggcuaugcuguacggcguugcgucccaacgcagcuccagagacaaugccacccgggcucacgaugcccagauugacacagccggcgauacguucgcuccuaagaucggacaggugcgcuucaaaucuagcuccaacgacuuugaucuucaugaccccaccaaguucacaccgaucggggucaauguggaugaccagcacccuuuuagacaaugguuccugcccaacuacggcgggcaccucgcccugaauaaccaucuugcgcccgcugucaccccucuguuuccgggagagcagauucucuucuuucggagcuauauccccucugccggcgggcacacagauggagccauggacugccugcugccucaggaauggguggagcauuucuaccaggaggcugcccccucccaaagcgacauugcucucguuagauuuaucaauccugauaccggccgcgugcuguucgaagccaaacuucacaagcagggcuuucugacgauugcggccucuggggaccaccccaucgucaugccuacaaacggauauuuccgguuugaggcuugggugaaucccuucuacacccucgccccgguuggcaccgggagcggaagacgccggauccaguga

SEQ ID NO: 28037 - RNA, 1626 nt, Artificial Sequence
  derived and/or modified sequence opt5 from capsid_protein__Norovirus__ABS29273
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugauucagccccggcuuugcacccaugcucgcuggccugcgcccaucuacggccugcucguugacccuucucugcccuccaauccgcaauggcagaacgggagagugcacgucgauggaacacuucugggcaccacgccuauuagcggcucuuggguguccuguuucgccgcugaagccgccuaugaguuucagagcgggaucggagagguugcuacauucacccucauugaacaagacggcucugccuacgugcccggggaucgggcggcuccucugggauaccccgacuuuuccggccagcuggagaucgaaguccagacagagaccaccaagacaggggacaaacucaaggugacgaccuucgaaaugauccugggaccuacaaccaaugccgaucaggcccccuaucaaggccgcgucuucgcuagcgugacagccgcugccucccuugaccugguugauggcagagugcgggcggucccgcgcucuguguacagcuuuugcgacaccauuccugaguauaacgaugggcuccugguuccccuugcucccccuaucggaccguuccugcccggcgaggugcuccugagauuucggacguacaugagacagcuggacacagccgaugccgcugccgaagcgauugacugugcccucccucaggaguucgucuccugguuugcuagcaaugccuucaccgugcagucugaagcucugcuucugcgcuaucggaacacccucacagggcaacugcuguuugagugcaaacuuuacuccgaaggauauaucgcccucagcuacucuggcagcgggccccugaccuucccuacagauggcuuuuucgaggugguuuccuggguccccagacuguaccagcucgccucugugggaagccuggcuacgggccgcacccuuaagcaguga

SEQ ID NO: 28038 - RNA, 1626 nt, Artificial Sequence
  derived and/or modified sequence opt5 from capsid_protein__Norovirus__ABS29275
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugauucagccccggcuuugcacccaugcucgcuggccugcgcccguuuacggccugcucguggacccuucucugcccuccaauccgcaauggcagaacgggagaguccacguggauggaacacuucugggcaccacgccuaucagcggcucuuggguuuccuguuucgccgcugaagccgccuaugaguuucagagcgggauuggagagguggcuacauucacccucaucgaacaagacggcucugccuacauucccggggaucgggcggcuccucugggauaccccgacuuuuccggccagcuggagaucgaaguccagacagagaccaccaagacaggggacaaacucaaggugacgaccuucgaaaugguccugggaccuacaaccaauguggaucaggcccccuaucaaggccgcguuuacgccagcgugacagcugccgcuucccuugaccuggucgauggcagagugcgggccguuccgcgcucuaucuauagcuuccaggacaccauuccugaguacaacgaugggcuccuggugccccuugcgcccccuaucggaccguuucugcccggcgagguccuccugagauuccggacguauaugagacagcuggacacagccgaugcugccgcugaagccauugacugcgcgcucccucaggaguuuguguccugguucgccagcaaugcuuuuaccgugcaaucugaagcccugcuucugcgcuaccggaacacccucacagggcagcugcuguucgaguguaaacuuuauuccgaaggauacaucgcucucagcuacucuggcagcgggccccugaccuuuccuacagauggcuucuuugagguugucuccugggugcccagacuguaucagcucgccucugugggaagccuggccacgggccgcacccuuaagcaguga

SEQ ID NO: 28039 - RNA, 1626 nt, Artificial Sequence
  derived and/or modified sequence opt5 from capsid_protein__Norovirus__ABU55541
augagaaugagcgacggcgccgcucccaaggccaacggguccgaggcgucuggacaggaucuggugccugcugccgucgaacaagccguuccgauccagcccguggcuggcgccgcucucgccgcgccugccgcugggcagauuaaucagaucgaccccuggauuuuccaaaacuuugugcagugcccucugggagaguucagcaucagcccccggaauaccccuggcgaaauucuuuuugaucuggcccucgggccgggacugaaccccuaccuugcucaccugucugccauguauacaggcugggucggcaauauggaggugcagcucguucuggcggggaacgccuucacggcuggaaaaguggucguggcccugguuccucccuacuuuccuaagggcagccucaccacagcucagaucaccuguuucccccaugugaugugcgacguccgcacacuggaaccgauccaacuuccucugcucgaugugagacgggugcuguggcacgccacccaggaccaggaggaguccaugcgccuugucuguaugcuguauacaccccucagaaccaauucuccuggggaugaauccuuuguuguguccggacggcugcugagcaaacccgccgcugacuucaacuuuguguaccucacgcccccuauugagcgcaccaucuauagaauggucgaucugccggugauucagccccggcuuugcacacaugcgcgcuggccugcccccguuuacggccugcucguggacccuucucugcccuccaauccgcaauggcagaacgggagaguccacguggauggaacccuucugggcacaaccccuaucagcggcucuuggguuuccuguuucgcugccgaagccgcuuauaaguuucagagcgggacgggagagguggccacauucacccucauugagcaagacggcucugcguacguccccggggaucgggcugccccucugggauaccccgacuuuuccggccagcuggaaaucgaggugcagacagaaaccaccaaaacaggggacaagcucaaggucacgaccuucgagaugauucugggaccuacaaccaaugccgaucaggcucccuaucaaggccgcguguucgccagcguuacagcugccgcgucccuugaccugguggauggcagaguccgggccgugccgcgcucuaucuacggguuucaggacaccaucccugaauauaacgauggacuccugguuccccuugcucccccuauuggcccguuccugcccggggaggugcuccugagauuucggacguacaugagacagaucgacacagccgaugcugccgcggaggccauugacugcgcucugccucaggaguucgucagcugguuugccuccaaugcuuucaccgugcaaagcgaagcccuccugcuucgcuaucggaacacccugacaggacagcuccuguuugaauguaaacuguacaaugagggcuauaucgcccuuucuuacuccgggagcggcccccucaccuucccuacagauggaauuuuugaagugguuucuuggguccccagacuguaccagcuggcuagcgugggcucccucgcgacggggcgcaugcugaagcaguga

SEQ ID NO: 28040 - RNA, 1626 nt, Artificial Sequence; identical to SEQ ID NO: 28039
  derived and/or modified sequence opt5 from capsid_protein__Norovirus__ABU55544

SEQ ID NO: 28041 - RNA, 1626 nt, Artificial Sequence
  derived and/or modified sequence opt5 from capsid_protein__Norovirus__ABU55547
augagaaugagcgacggcgccgcucccaaggccaacggguccgaggcgucuggacaggaucuggugccugcugccgucgaacaagccguuccgauccagcccguggcuggcgccgcucucgccgcgccugccgcugggcagauuaaucagaucgaccccuggauuuuccaaaacuuugugcagugcccucugggagaguucagcaucagcccccggaauaccccuggcgaaauucuuuuugaucuggcccucgggccgggacugaaccccuaccuugcucaccugucugccauguauacaggcugggucggcaauauggaggugcagcucguucuggcggggaacgccuucacggcuggaaaaguggucguggcccugguuccucccuacuuuccuaagggcagccucaccacagcucagaucaccuguuucccccaugugaugugcgacguccgcacacuggaaccgauccaacuuccucugcucgaugugagacgggugcuguggcacgccacccaggaccaggaggaguccaugcgccuugucuguaugcuguauacaccccucagaaccaauucuccuggggaugaauccuuuguuguguccggacggcugcugagcaaacccgccgcugacuucaacuuuguguaccucacgcccccuauugagcgcaccaucuauagaauggucgaucugccggugauucagccccggcuuugcacacaugcgcgcuggccugcccccguuuacggccugcucguggacccuucucugcccuccaauccgcaauggcagaacgggagaguccacguggauggaacccuucugggcacaaccccuaucagcggcucuuggguuuccuguuucgcugccgaagccgcuuauaaguuucagagcgggacgggagagguggccacauucacccucauugagcaagacggcucugcguacguccccggggaucgggcugccccucugggauaccccgacuuuuccggccagcuggaaaucgaggugcagacagaaaccaccaaaacaggggacaagcucaaggucacgaccuucgagaugauucugggaccuacaaccaaugccgaucaggcucccuaucaaggccgcguguucgccagcguuacagcugccgcgucccuugaccugguggauucuagaguccgggccgugccgcgcagcaucuacggcuuucaggacaccaucccugaauauaacgaugggcuccugguuccccuugcucccccuauuggaccguuccugcccggcgaggugcuccugagauuucggacguacaugagacagaucgacacagccgaugcugccgcggaggccauugacugcgcucugccucaggaguucgucuccugguuugccagcaaugcuuucaccgugcaaucugaagcccuccugcuucgcuaucggaacacccugacagggcagcuccuguuugaauguaaacuguacaaugagggauauaucgcccuuuccuacagcggcucugggccccucaccuucccuacagauggcauuuuugaagugguuagcuggguccccagacuguaccagcuggcuuccgugggaucucucgcgacgggccgcaugcugaagcaguga

SEQ ID NO: 28042 - RNA, 1626 nt, Artificial Sequence; identical to SEQ ID NO: 28039
  derived and/or modified sequence opt5 from capsid_protein__Norovirus__ABU55550

SEQ ID NO: 28043 - RNA, 1626 nt, Artificial Sequence; identical to SEQ ID NO: 28039
  derived and/or modified sequence opt5 from capsid_protein__Norovirus__ABU55553

SEQ ID NO: 28044 - RNA, 1626 nt, Artificial Sequence
  derived and/or modified sequence opt5 from capsid_protein__Norovirus__ABU55556
augagaaugagcgacggcgccgcucccaaggccaacggguccgaugcgucuggacaggaccuggugccugcugccgucgagcaagccguuccgauccagcccguggcuggcgccgcucucgccgcgccugccgcugggcagauuaaucagaucgaucccuggauuuuccaaaacuuugugcagugcccucugggagaguucagcaucucuccccggaauaccccuggcgaaauucuuuuugaccuggcccucgggccgggacugaaccccuaccuugcucaccuguccgccauguauacaggcugggucggcaauauggaagugcagcucguucuggcggggaacgccuucacggcuggaaaaguggucguggcccugguuccucccuacuuuccuaagggcagccucaccacagcucagaucaccuguuucccccaugugaugugcgauguccgcacacuggagccgauccaacuuccucugcucgacgugagacgggugcuguggcacgccacccaggaucaggaagaguccaugcgccuugucuguaugcuguauacaccccucagaaccaauucuccuggggacgagagcuuuguuguguccggacggcugcugagcaaacccgccgcugauuucaacuuuguguaccucacgcccccuauugaacgcaccaucuauagaauggucgaccugccggugauucagccccggcuuugcacacaugcgcgcuggccugcccccguuuacggccugcucguggauccuucucugcccuccaauccgcaauggcagaacgggagaguccacguggacggaacccuucugggcacaaccccuaucagcggcucuuggguuuccuguuucgcugccgaggccgcuuauaaguuucagagcgggacgggagaaguggccacauucacccucauugagcaagauggcucugcguacguccccggggaccgggcugccccucugggauaccccgacuuuuccggccagcuggagaucgaagugcagacagagaccaccaaaacaggggauaagcucaaggucacgaccuucgaaaugauucugggaccuacaaccaaugccgaccaggcucccuaucaaggccgcguguucgccagcguuacagcugccgcgucccuugaucugguggacggcagaguccgggccgugccgcgcucuaucuacggguuucaggauaccaucccugaguauaacgacggacuccugguuccccuugcucccccuauuggcccguuccugcccggggaagugcuccugagauuucggacguacaugagacagaucgauacagccgacgcugccgcggaggccauugauugcgcucugccucaggaguucgucagcugguuugccuccaaugcuuucaccgugcaaagcgaagcccuccugcuucgcuaucggaacacccugacaggacagcuccuguuugaguguaaacuguacaaugaaggcuauaucgcccuuucuuacuccgggagcggcccccucaccuucccuacagacggaauuuuugaggugguuucuuggguccccagacuguaccagcuggcuagcgugggcucccucgcgacggggcgcaugcugaagcaguga

SEQ ID NO: 28045 - RNA, 1626 nt, Artificial Sequence
  derived and/or modified sequence opt5 from capsid_protein__Norovirus__ABU55559
augagaaugagcgacggcgccgcucccaaggccaacggguccgaggcgucuggacaggaucuggugccugcugccgucgaacaagccguuccgauccagcccguggcuggcgccgcucucgccgcgccugccgcugggcagauuaaucagaucgaccccuggauuuuccaaaacuuugugcagugcccucugggagaguucagcaucagcccccggaauaccccuggcgaaauucuuuuugaucuggcccucgggccgggacugaaccccuaccuugcucaccugucugccauguauacaggcugggucggcaauauggaggugcagcucguucuggcggggaacgccuucacggcuggaaaaguggucguggcccugguuccucccuacuuuccuaagggcagccucaccacagcucagaucaccuguuucccccaugugaugugcgacguccgcacacuggaaccgauccaacuuccucugcucgaugugagacgggugcuguggcacgccacccaggaccaggaggaguccaugcgccuugucuguaugcuguauacaccccucagaaccaauucuccuggggaugaauccuuuguuguguccggacggcugcugagcaaacccgccgcugacuucaacuuuguguaccucacgcccccuauugagcgcaccaucuauagaauggucgaucugccggugauucagccccggcuuugcacacaugcgcgcuggccugcccccguuuacggccugcucguggacccuucucugcccuccaauccgcaauggcagaacgggagaguccacguggauggaacccuucugggcacaaccccuaucagcggcucuuggguuuccuguuucgcugccgaagccgcuuaugaguuucagagcgggacgggagagguggccacauucacccucauugaacaagacggcucugcguacguccccggggaucgggcugccccucugggauaccccgacuuuuccggccagcuggagaucgaagugcagacagagaccaccaagacaggggacaaacucaaggucacgaccuucgaaaugauucugggaccuacaaccaaugccgaucaggcucccuaucaaggccgcguguucgccagcguuacagcugccgcgucccuugaccugguggauggcagaguccgggccgugccgcgcucuaucuacggguuucaggacaccaucccugaguauaacgauggacuccugguuccccuugcucccccuauuggcccguuccugcccggggaggugcuccugagauuucggacguacaugagacagaucgacacagccgaugcugccgcggaagccauugacugcgcucugccucaggaguucgucagcugguuugccuccaaugcuuucaccgugcaaagcgaagcccuccugcuucgcuaucggaacacccugacaggacagcuccuguuugaguguaagcuguacaaugaaggcuauaucgcccuuucuuacuccgggagcggcccccucaccuucccuacagauggaauuuuugaggugguuucuuggguccccagacuguaccagcuggcuagcgugggcucccucgcgacggggcgcaugcugaaacaguga

SEQ ID NO: 28046 - RNA, 1626 nt, Artificial Sequence; identical to SEQ ID NO: 28039
  derived and/or modified sequence opt5 from capsid_protein__Norovirus__ABU55562

SEQ ID NO: 28047 - RNA, 1626 nt, Artificial Sequence; identical to SEQ ID NO: 28039
  derived and/or modified sequence opt5 from capsid_protein__Norovirus__ABU55565

SEQ ID NO: 28048 - RNA, 1626 nt, Artificial Sequence
  derived and/or modified sequence opt5 from capsid_protein__Norovirus__ABU55568
augagaaugagcgacggcgccgcucccaaggccaacggguccgaggcgucuggacaggauuucgugccugcugccgucgaacaagccguuccgauccagcccguggcuggcgccgcucuggccgcgccugccgcugggcagauuaaucagaucgaccccuggauuuuucaaaacuucgugcagugcccucucggagaguuuagcaucagcccccggaauaccccuggcgaaauucuguucgaucuugcccuggggccgggacucaaccccuaccuggcucaccuuucugccauguauacaggcugggucggcaauauggaggugcagcugguucucgcggggaacgccuuuacggcuggaaaaguggucguggcccugguuccucccuacuucccuaagggcagccugaccacagcucagaucaccuguuuuccccaugugaugugcgacguccgcacacucgaaccgauccaacugccucuucuggaugugagacgggugcucuggcacgccacccaggaccaggaggaguccaugcgccuggucuguaugcuuuauacaccccugagaaccaauucuccuggggaugaauccuucguuguguccggacggcuccugagcaaacccgccgcugacuuuaacuucguguaccugacgcccccuauugagcgcaccgucuauagaaugguggaucucccgguucugcagccccggcuuugcacacaugcgcgcuggccugcccccguguacggccugcucaucgacccuucucugcccuccaauccgcaauggcagaacgggagaguccacgugaauggaacccuucugggcacaaccccuguuagcggcucuuggguguccuguuuugcugccgaagccgcuuaugaguuccagagcgggauuggagaggucgccacguuuacaaugaucgaacaagauggcucugcguacgugcccggggaccgggcugccccucucggauaccccgauuucuccggccagcuggagauugaaguccagaccgagacaaccaagagcggggacaaacugaaggugaccacauucgaaaugauccucggaccuacgaccaacgccgaccagacacccuaucaaggcaagguuuacgcuuccauugccgcugccgcgucucuggaucuuguggacggccgcgucagagccgugccgcggagcguuuaugcuuuucaggaugugcugccugaguacaaugacgggcuccuggucccccuugcucccccucugggaccguuccuccccggcgaggugcugcugcgcuuuagaaccuaugugcggcagcucgauacagcugacgccgcggcccagccuaucgauugcgcucugccccaagaguucaucuccugguuugccagcaacaauuucaccguucagucugacgcccuucugauuagauaccgcaacacgcucacagggcagcugcuguuugaagccaaacuuuauuccgaaggauacaucgccgucagcuacucuggcagcgggccucucaccuuccccaccgauggcuuuuucgaggugguguccugggucccucggcuguuucagcuggcuucugugggaagccucgcgacaggcagaacccugaagcaauga

SEQ ID NO: 28049 - RNA, 1626 nt, Artificial Sequence
  derived and/or modified sequence opt5 from capsid_protein__Norovirus__ABU55571
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccgucuauagaaugguggaucugccgguucuucagccccggcugugcacccaugcucgcuggccugcgcccaucuacggccuccugauugacccuucucuucccuccaauccgcaauggcagaacgggagagugcacgucaauggaacacugcucggcaccacgccugugagcggcucuuggguuuccuguuucgccgcugaagccgccuaugaguuucagagcgggacaggagagguggcuaccuucacaaugaucgaacaagauggcucugccuacguccccggggaccgggcggcuccucugggauaccccgauuuuuccggccagcuggagauugaagugcagaccgagaccacaaagacgggggacaaacucaaggucaccacauucgaaauggugcugggaccuaccacaaacguugaccaggcccccuaucaaggccgcaccuacgccagccuuacggcugccgcuucccuggaucucguggacggcagaguccgggccgugccgcgcucuaucuauagcuuccaggauguucugccugaguacaaugacgggcuucuggugccccucgcgcccccucugggaccguuucugcccggcgagguccuccugagauuccggacauauaugagacagcuugauaccgccgacgcugccgcucagccuauugauugcgcccugccccaagaauuuaucuccugguucgcgagcaacaauuuuaccgugcagucugacgcccuccugauccgcuaccggaacacacugaccgggcagcuucucuucgaggcuaagcuguauuccgaaggauacauugccgugagcuacucuggcagcgggccucugacauuucccacggauggcuucuuugagguugucuccugggugccuagacucuuccagcuggcuucugugggaagccuugccaccggccgcacacugaaacaauga

SEQ ID NO: 28050 - RNA, 1626 nt, Artificial Sequence
  derived and/or modified sequence opt5 from capsid_protein__Norovirus__ABU55577
augagaaugagcgacggcgccgcucccaaggccaacggguccgaggcgaucggacaggaucuggugccuaccgcugucgaacaagccguuccgauucagcccguggccggcgcugcccucgcugccccugcggccgggcagaucaaucagauugaccccuggaucuuccaaaacuuugugcagugcccucugggagaguucucuauuagcccccggaauacaccuggcgaaauccuuuuugaucuggcucucgggccgggacugaaccccuaccuugcccaccuguccgcuauguauacgggcugggucggcaauauggaggugcagcucguucuggccgggaacgcguucaccgccggaaaaguggucguggcucugguuccucccuacuuuccuaagggcucucucacaaccgcccagaucacauguuucccccaugugaugugcgacguccgcgcucuggaaccgauucaacuuccucugcucgaugugagacgggugcuguggcacgccacccaggaccaggaggagagcaugcgccuugucuguaugcuguauacaccccucagaaccaauuccccuggggaugaaucuuuuguugugagcggacggcugcuguccaaacccgccgcugacuucaacuuuguguaccucacgcccccuaucgagcgcaccgucuauagaaugguggaucugccgguucuucagccccggcugugcacacaugcgcgcuggccugcccccguguacggccuccuggucgacccuagccuucccucuaauccgcaauggcagaacgggagagugcacguuaauggaacccugcucggcacaaccccuguguccggcagcugggucucuuguuucgcugccgaagccgcuuaugaguuucaguccgggacgggagagguggccacauucaccaugauugaacaagauggcagcgcguacguccccggggaccgggcugccccucugggauaccccgauuuuucuggccagcuggagaucgaagugcagacagagaccaccaaguccggggacaaacucaagguuacaacguucgaaaugauucugggaccuaccacaaacgccgaccagacccccuaucaaggccgcguguacgcuagcaucgccgcugccgcgccgcuugaucuggucgacggcagagugcgggccguuccucgcuccguguauuucuuucaggauguccuccccgaguacaaugacgggcugcuugugccccuggcuccuccgcucggacccuuccugccuggcgaggugcugcucagauuucggacauauguuagacagcuggauaccgccgacgcugccgcgcagcccauugauugcgcccuuccucaagaguucaucucuugguuugcuagcaacuccuucacgguccagagcgaagcccugcucauccgcuaccggaauacacugaccgggcagcugcuuuuugaagcuaagcucuauucugagggauacauugccguguccuacagcggcucugggccccugaccuucccuacagacggcuuuuucgaaguggucagcugggugcccagacuguuucagcucgccuccguuggaucucuggcuaccggccgcacacuuaaacaauga

SEQ ID NO: 28051 - RNA, 1626 nt, Artificial Sequence
  derived and/or modified sequence opt5 from capsid_protein__Norovirus__ABU55580
augagaaugagcgacggcgccgcucccaaggccaacggguccgaggcgaucggacaggaucuggugccuaccgcugucgaacaagccguuccgauucagcccguggccggcgcugcccucgcugccccugcggccgggcagaucaaucagauugaccccuggaucuuccaaaacuuugugcagugcccucugggagaguucucuauuagcccccggaauacaccuggcgaaauccuuuuugaucuggcucucgggccgggacugaaccccuaccuugcccaccuguccgcuauguauacgggcugggucggcaauauggaggugcagcucguucuggccgggaacgcguucaccgccggaaaaguggucguggcucugguuccucccuacuuuccuaagggcucucucacaaccgcccagaucacauguuucccccaugugaugugcgacguccgcgcucuggaaccgauucaacuuccucugcucgaugugagacgggugcuguggcacgccacccaggaccaggaggagagcaugcgccuugucuguaugcuguauacaccccucagaaccaauuccccuggggaugaaucuuuuguugugagcggacggcugcuguccaaacccgccgcugacuucaacuuuguguaccucacgcccccuaucgagcgcaccgucuauagaaugguggaucugccgguucuucagccccggcugugcacacaugcgcgcuggccugcccccguguacggccuccuggucgacccuagccuucccucuaauccgcaauggcagaacgggagagugcacguuaauggaacccugcucggcacaaccccuguguccggcagcugggucucuuguuucgcugccgaagccgcuuaugaguuucaguccgggacgggagagguggccacauucaccaugauugaacaagauggcagcgcguacguccccggggaccgggcugccccucugggauaccccgauuuuucuggccagcuggagaucgaagugcagacagagaccaccaaguccggggacaaacucaagguuacaacguucgaaaugauucugggaccuaccacaaacgccgaccaggcucccuaucaaggccgcguguacgccagccuugcugccgcggccccgcuggaucucgucgacggcagagugcgggcuguuccucgcuccguguauuucuuucaggauguccugcccgaguacaaugacgggcuucuggugccccucgccccuccgcugggacccuuccugccuggcgaggugcuccugagauuucggaccuauguuagacagcuugauacagcugacgccgcggcccagcccaucgauugcgcucugccucaagaguucauuucuugguuugccagcaacuccuucaccguccagagcgaagcucuccugauccgcuaccggaauacgcugacagggcagcuucucuuugaagccaagcuguauucugagggauacaucgccguguccuacagcggcucugggccccugaccuucccuaccgacggcuuuuucgaaguggucagcugggugcccagacucuuucagcuggcuuccguuggaucucuugcgacaggccgcacccugaaacaauga

SEQ ID NO: 28052 - RNA, 1626 nt, Artificial Sequence
  derived and/or modified sequence opt5 from capsid_protein__Norovirus__ABU55586
augagaaugagcgacggcgccgcucccaaggccaacggguccgaggcgaucggacaggaucuggugccuaccgcugucgaacaagccguuccgauucagcccguggccggcgcugcccucgcugccccugcggccgggcagaucaaucagauugaccccuggaucuuccaaaacuuugugcagugcccucugggagaguucucuauuagcccccggaauacaccuggcgaaauccuuuuugaucuggcucucgggccgggacugaaccccuaccuugcccaccuguccgcuauguauacgggcugggucggcaauauggaggugcagcucguucuggccgggaacgcguucaccgccggaaaaguggucguggcucugguuccucccuacuuuccuaagggcucucucacaaccgcccagaucacauguuucccccaugugaugugcgacguccgcgcucuggaaccgauucaacuuccucugcucgaugugagacgggugcuguggcacgccacccaggaccaggaggagagcaugcgccuugucuguaugcuguauacaccccucagaaccaauuccccuggggaugaaucuuuuguugugagcggacggcugcuguccaaacccgccgcugacuucaacuuuguguaccucacgcccccuaucgagcgcaccgucuauagaaugguggaucugccgguucuucagccccggcugugcacacaugcgcgcuggccugcccccguguacggccuccuggucgacccuagccuucccucuaauccgcaauggcagaacgggagagugcacguuaauggaacccugcucggcacaaccccuguguccggcagcugggucucuuguuucgcugccgaagccgcuuaugaguuucaguccgggacgggagagguggccacauucaccaugauugaacaagauggcagcgcguacguccccggggaccgggcugccccucugggauaccccgauuuuucuggccagcuggagaucgaagugcagacagagaccaccaaguccggggacaaacucaagguuacaacguucgaaaugauucugggaccuaccacaaacgccgaccaggcucccuaucaaggcaagguguacgccagccuugcugccgcggccccgcuggaucucgucgacggccgcgugagagcuguuccucgguccguguauuucuuucaggauguccugcccgaguacaaugacgggcuucuggugccccucgccccuccgcugggacccuuccugccuggcgaggugcuccugcgcuuuagaaccuauguucggcagcuugauacagcugacgccgcggcccagcccaucgauugcgcucugccucaagaguucauuucuugguuugccagcaacuccuucaccguccagagcgacgcucuccugaucagauaccgcaauacgcugacagggcagcuucucuuugaagccaaacuguauucugaaggauacaucgccguguccuacagcggcucugggccccugaccuucccuaccgauggcuuuuucgagguggucagcugggugccccggcucuuucagcuggcuuccguuggaucucuugcgacaggcagaacccugaagcaauga

SEQ ID NO: 28053 - RNA, 1626 nt, Artificial Sequence
  derived and/or modified sequence opt5 from capsid_protein__Norovirus__ABU55589
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccgucuauagaaugguggaucugccgguucuucagccccggcugugcacccaugcucgcuggccugcgcccguguacggccuccugaucgacccuucucuucccuccaauccgcaauggcagaacgggagaguccacgugaauggaacacugcucggcaccacgccuguuagcggcucuuggguguccuguuucgccgcugaagccgccuaugaguuucagagcgggacaggagaggucgcuaccuucacaaugauugaacaagauggcucugccuacgugcccggggaccgggcggcuccucugggauaccccgauuuuuccggccagcuggagaucgaaguccagaccgagaccacaaagagcggggacaaacuccgcgugacgaccuucgaaaugauucugggaccuacaaccaacguugaccaggcccccuaucaaggcagaguguacgccucccuugcugccgcugccucucuggaucucgucgacggccgggugcgcgcgguuccgagaagcguguauuccuuccaggauguccugccugaguacaaugacgggcuucuggugccccucgcucccccucugggaccguuucugcccggcgaggugcuccugcgguucagaacauauaugcgccagcuugauaccgccgacgccgcugcccagccuaucgauugcgcgcugccccaagaauuuauuagcugguucgccucuaacaauuuuacgguucaguccgacgcucuccugauccgguacagaaacacacugaccgggcagcuucucuucgaggccaagcuguauagcgaaggauacaucgcugucucuuacagcggcuccgggccucugaccuuucccacagauggcuucuuugagguggugucuugggucccucgccucuuccagcuggccagcgugggaucccuugccaccggccggacacugaagcaauga

SEQ ID NO: 28054 - RNA, 1626 nt, Artificial Sequence
  derived and/or modified sequence opt5 from capsid_protein__Norovirus__ABU55598
augagaaugagcgacggcgccgcucccaaggccuccgggucugaggcgagcggacaggaucuggugccuaccgcugucgaacaagccguuccgauccagcccguggccggcgcugcccucgcugccccugcggccgggcagauuaaccagaucgaccccuggauuuuccaaaauuuugugcagugcccucugggagaguucuccaucucuccccggaacacaccuggcgaaauucuuuuugaucuggcucucgggccgggacugaaucccuaccuugcccaccugagcgcuauguauacgggcugggucggcaacauggaggugcagcucguucuggccgggaaugcguucaccgccggaaaaguggucguggcucugguuccucccuacuuuccuaagggcucccucacaaccgcccagaucacauguuucccccaugugaugugcgacguccgcacccuggaaccgauccaacuuccucugcucgaugugagacgggugcuguggcacgcuacacaggaccaggaggagucuaugcgccuugucuguaugcuguauacgccccucagaaccaacagcccuggggaugaauccuuuguugugagcggacggcugcugucuaaacccgccgccgacuucaauuuuguguaccucacacccccuauugagcgcaccaucuauagaauggucgaucugccggugcuucagccccggcugugcacccaugcucgcuggccugcgcccguuuacggccuccugguggacccuucccuucccagcaacccgcaauggcagaaugggagaguccacauugauggaacacugcucggcaccacgccugugucuggcuccuggguuagcuguuucgccgcugaagccgccuaugaguuucagucugggacaggagagguggcuaccuucacacugaucgaacaagacggcuccgccuacguccccggggaucgggcggcuccucugggauaccccgacuuuagcggccagcucgagauugaagugcagaccgagaccacacgcgccggggacaagcugaaagucacgaccuucgaaaugauccuuggaccuacaaccaacguggaucaggcccccuaucaaggcagaguuuacgcuucccugacagccgcugccucucucgaccugguggauggccggguccgcgcggugccgagaagcauuuauuccuuccaggacguucuuccugaguacaaugaugggcugcucgugccccuggcucccccuaucggaccguuucugcccggcgagguccuccugcgguucagaaccuauaugcgccagguggacagcucugaugccgccgcugaagccaucgacugcgcgcuuccucaggaguuuguguccugguucgccagcaacggguuuacgguucaaucugaagcucugcuccugcgguacagaaauacacugaccggacagcuucucuucgaguguaagcuguauagcgaaggcuacauugcccuguccuacucugggagcggcccccucaccuuuccuacagauggauucuuugaggucguguccugggugccccgccuguuccagcuugcuagcgucggcucucuggugaccgggcggacacucaagcaguga

SEQ ID NO: 28055 - RNA, 1626 nt, Artificial Sequence
  derived and/or modified sequence opt5 from capsid_protein__Norovirus__ABU55601
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggcugaucugccgguccuucagccccggcugugcacccaugcgcgcuggccugcccccguguacggccuccugguugacccuucucuucccuccaauccgcaauggcagaacgggagagugcacgucgauggaacacugcucggcaccacgccuauuagcggcucuuggguguccuguuucgcugccgaagccgcuuaugaguuucagagcgggacaggagagguugccacccugacacugaucgaacaagacggcucugcguacgugcccggggaucgggcugccccucucggauaccccgacuucuccggccagcuggagauugaaguccagaccgagaccacaaaggccggggacaaacuuaaggugacgaccuuugauaugauccugggaccuacaaccaaugucgaccaggcucccuaucaaggccgcguguacgccagcguuuccacagcugccucucucggccugguggaugggagaguccgggcggugccgcgcagcauuuauggauuccaggacaccaucccugaauacaacgauggccuucugguuccccucgcucccccuaucgggccguuccugcccggagaggugcugcucagauuucggacguauaugagacagauugacacagcugaugccgcugccgaggcgaucgacugcgcccugccucaggaguucauuuccugguuugcuagcaaugccuucaccguccaaucugaagcccuucugcuccgcuaccggaacacccugacaggccagcugcuuuuugaauguaagcucuauuccgagggguacaucgcccugagcuacucuggcagcggaccccugaccuucccuacagauggcuuuuucgaagccguguccugggugcccagacucuaucagcuggcuucuguugggagccuugcgacgggacgcacccugaaacaguga

SEQ ID NO: 28056 - RNA, 1626 nt, Artificial Sequence
  derived and/or modified sequence opt5 from capsid_protein__Norovirus__ABU55604
augagaaugagcgacggcgccgcuccccgggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccgcaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaagguggucguggcucugguuccucccuacuuuccuaagggcagccucacaaccgcccagaucacauguuucccccaugugaugugcgacgucagaacccuggaaccgauccaacuuccucugcucgaugugcggcgcgugcuguggcacgcuacacaggaccaggaggaguccaugagacuugucuguaugcuguauacgccccuccggaccaauucuccuggggaugaauccuuuguuguguccggacgccugcugagcaagcccgccgccgacuucaacuuuguguaccucacacccccuauugagagaaccaucuaucggauggucgaucugccggugauucagccccgccuuugcacccaugcuagauggccugcgcccaucuacggccugcucguugacccuucucugcccuccaauccgcaauggcagaacgggcgggugcacgucgauggaacacuucugggcaccacgccuauuagcggcucuuggguguccuguuucgccgcugaagccgccuaugaguuucagagcgggacaggagagguugcuaccuucacacucaucgaacaagacggcucugccuacgugcccggggaucgcgcggcuccucugggauaccccgacuuuuccggccagcuggagauugaaguccagaccgagaccacaaaaacgggggacaagcucaaagugaccacauucgaaaugauccugggaccuaccacaaaugucgaucaggcccccuaucaaggcagaguguacgccagcguugcugccgcugccucccuugaccugguggauggccggguccgcgcggugccgagaucuaucuauggguuccaggacguuauuccugaguacaacgauggacuccuggugccccuugcucccccuaucggcccguuucugcccggggagguccuccugcgguucagaaccuauaugcgccagcuggacacggccgaugccgcugccgaagcgauugacugcgcccucccucaggaguuugugagcugguucgcuuccaaugccuuuacagugcaaagcgaagcucugcuucugcgguacagaaacacccucaccggacagcugcuguucgaguguaaacuuuauucugaaggcuacaucgcccucuccuacagcgggucuggcccccugacauuuccugccgauggauucuuugagguugucagcugggugccccgccuguaucagcucgcuuccgugggcucucuggcgaccgggcggaugcuuagacaguga

SEQ ID NO: 28057 - RNA, 1626 nt, Artificial Sequence
  derived and/or modified sequence opt5 from capsid_protein__Norovirus__ABU55607
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgcccccgacuucaacuuuguguaccucaccccuccgauugagcgcacaaucuauagaauggucgaucugcccgugcuucagccucggcugugcacccaugcccgcuggcccgcuccuguuuacggccuccugguggaccccucucuuccguccaauccucaauggcagaacgggagaguccagguggauggaacacugcucggcaccacgcccguuagcggcucuuggguguccuguuucgcggccgaagcugccuaugaguuucaagccgggacaggagaggucgugaccuucacaaugauugaacaggacggcagcgcuuacgucccuggggaucgggccgcgccccugggauacccugacuuuucuggccagcuggagaucgaagugcagaccgagaccacaaagacgggggacaaacuccgcguuaccacauucgaaaugauucugggacccaccacaaauguggaucaagcuccguaucagggcagagccuacgccucccuuaccgcugccgcuagccuggaccucgucgauggccgggugcgcgccguuccuagauccaucuauucuuuccaggacgagcugcccgaguacaacgaugggcuucuggugccccucgcgccuccgcugggacccuuucugccuggcgaaguccuccugcgguucagaacguauaugcgccagcuugacacagccgaugcugccgcucaacccauugacugcgcccugccucaggaguuuaucagcugguucgcguccaauaacuuuaccgugcagagcgaugcccuccuggugcgguacagaaauacccugacagggcagcuucucuucgaagcuaagcuguauucugagggauacaucgccguuuccuacagcggcucugggccccugaccuuuccuacagacggcuucuuugaagucgugagcugggugccccgccucuuccaacuggcuuccgucggaucucuugugacgggccggacccugaagcaguga

SEQ ID NO: 28058 - RNA, 1626 nt, Artificial Sequence
  derived and/or modified sequence opt5 from capsid_protein__Norovirus__ABU55610
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcgucucuccccggaauacaccuggcgaaauccuuuuugaucuggcucucgggccgggacugaaccccuaccuugcccaccuguccgcuauguauacgggcugggugggcaauauggagguucagcucgugcuggccgggaacgcguucaccgccggaaaagucgugguugcucuggugccucccuacuuuccuaagggcagccucacaaccgcccagauuacauguuucccccaugucaugugcgacgugcgcacccuggaaccgauccaacuuccucugcucgaugugagacggguccuguggcacgcuacacaggaccaggaggaguccaugcgccuuguuuguaugcuguauacgccccucagaaccaauucuccuagcgaugaauccuuuguggugagcgggcggcugcugucuaaacccgccgccgacuucaacuuugucuaccucacacccccuaucgagcgcaccauuuauagaaugguggaucugccgguucuucagccccggcugugcacccaugcucgcuggccugcgcccguguacggacuccuggucgacccuucccuucccagcaauccgcaauggcagaacggcagagugcacguugaugggacacugcucggaaccacgccuaucucuggcuccugggugagcuguuucgccgcugaagccgccuaugaguuucagucuggcacaggggaggucgcuaccuucacacugguggaacaagacggauccgccuacguccccggcgaucgggcggcuccucugggguaccccgacuuuagcggacagcucgagauugaagugcagaccgagaccacaaagccuggcgaaaaacugaagguuacgaccuucgagaugauccuugggcccacaaccaauguggaccaggccccguaucgcggaaaggucuucgccuccauuacaaccgcugccucucugagccucguggauggcagaguucgggcugugccucgcuccaucuacagcuuucaagacgucauucccgaguauaacgauggccugcuugugccccuggccccuccgaucgggcccuuccucccuggagaagugcugcugagauuucggacguacaugagacagcucgacucugcggaugccgcugccgaggcuaucgacugcgcccugccccaggaguucguuuccugguuugcgagcaaugccuucacaguccagucugaagcccuucugcuccgcuaucggaacacccugaccggccaacugcuuuuugaauguaaacucuacagcgagggguauauugcucuguccuacucuggaagcggcccucugacauuccccaccgauggguuuuucgaggugguguccugggucccuagacucuaccagcuggcuagcgugggcucucuugccacaggacgcacgcugaagcaguga

SEQ ID NO: 28059 - RNA, 1626 nt, Artificial Sequence
  derived and/or modified sequence opt5 from capsid_protein__Norovirus__ABU55613
augagaaugagcgacggcgccgcucccaaggccaacggguccgaggcgucuggacaggaucuggugccuaccgcugucgaacaagccguuccgauccagcccguggccggcagcgcucucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggugcuucagccccggcugugcacccaugcccgcuggccugcucccauuuacggccuccugguugacccuucccuucccagcaauccgcaauggcagaacgggagagugcacgucgauggaacacugcucggcaccacgccugugucuggcuccuggguuagcuguuucgcggccgaagcugccuaugaguuucagucugggacaggagagguggccaccuucacacugaucgaacaagacggcuccgcuuacguccccggggaucgggccgcgccucugggauaccccgacuuuagcggccagcucgagauugaagugcagaccgagaccacaaagacgggggacaaacugaaggucaccacauucgaaaugauccuuggaccuaccacaaauguggaucaggcucccuaucaaggccgcguuuacgccucccugaccgccguggcuucucucgaccuggucgauggcagagugcgggccguuccgcgcagcauuuauggguuccaggacgugaucccugaguacaacgauggacuucuggucccccucgcucccccuaucggcccguuucugcccggggaggugcugcucagauuccggacguauaugagacagcuggacacagccgaugcggccgcugaagccauugacugcgcccuuccucaggaguuuaucuccugguucgcuagcaaugcguuuaccgugcaaucugaugcccugcuccugcgcuaccggaacacccugacaggacagcuucucuucgaauguaagcuguauuccgagggcuacauugcucugagcuacucugggagcggcccccucaccuuuccuacagacggauucuuugaaguugucuccugggugcccagacuguuccagcuugccucugugggcagccugacgaccgggcgcacacucaaacaguga

SEQ ID NO: 28060 - RNA, 1626 nt, Artificial Sequence
  derived and/or modified sequence opt5 from capsid_protein__Norovirus__ABU55616
augagaaugagcgacggcgccgcccccaaggccaacggguccgaggcgucuggacaggaucuggugccuaccgcuaucgaacaagccgucccgauucagcccguugccggcagcgcucucgccgcuccugccgcggggcagaucaaucagauugaccccuggaucuuccaaaacuuugugcagugcccucugggagaguucuccauuucuccccggaauacaccuggcgaaauccuuuuugaucuggcccucgggccgggacugaaccccuaccuugcucaccugagcgccauguauacgggcugggugggcaauauggagguccagcucgugcuggcugggaacgccuucaccgcgggaaaaguuguggucgcccuggugccucccuacuuuccuaagggcucccucacaaccgcucagaucacauguuucccccauguuaugugcgacgugcgcacccuggaaccgauucaacuuccucugcucgaugucagacgggugcuguggcacgccacacaggaccaggaggagucuaugcgccuuguguguaugcuguauacgccccucagaaccaauagcccuggggaugaauccuuugucguuagcggacggcugcugucuaaacccgcugccgacuucaacuuuguguaccucacacccccuaucgagcgcaccauuuauagaaugguggaucugccgguccuucagccccggcugugcacccaugcccgcuggccugcucccaucuacggccuccugguggacccuucccuucccagcaauccgcaauggcagaacgggagaguucacguggauggaacacugcucggcaccacgccugucucuggcuccugggugagcuguuucgcggccgaagcugccuaugaguuucagucugggacaggagagguugccaccuucacacugauugaacaagacggcuccgcuuacgugcccggggaucgggccgcgccucugggauaccccgacuuuagcggccagcucgagaucgaaguccagaccgagaccacaaagacgggggacaaacugaaggugaccacauucgaaaugauucuuggaccuaccacaaaugucgaucaggcucccuaucaaggcaagguguacgccucccuggccguugcugccucucucgaccugguggauggccgcgucagagcugugccgcggagcaucuauggguuccaggacguuaucccugaguacaacgauggacuucuggugccccucgcgcccccuauuggcccguuucugcccggggagauccugcuccgcuucagaaccuauaugcggcagcuggacacggccgaugccgcugccgaagcuauugacugcgcccuuccucaggaguuuaucuccugguucgcgagcaaugccuuuacaguccaagcugaugcccugcuccugagauaccgcaacacccugaccggacagcuucucuucgaauguaaacuguauucugagggcuacauugcucuguccuacagcgggucugcuccccucacauuuccuaccgacggcuucuuugaaguggugagcuggguuccccggcuguuccagcuugccuccgucggaucucugacaacgggcagaacccucaagcaguga

SEQ ID NO: 28061 - RNA, 1626 nt, Artificial Sequence
  derived and/or modified sequence opt5 from capsid_protein__Norovirus__ABU55619
augagaaugagcgacggcgccgcucccaaggccaacggguccgaggcgucuggacaggaucuggugccuaccgcugucgaacaagccguuccgauccagcccguggccggcagcgcucucgccgcuccugccgcggggcagauuaaucagaucgaccccuggauuuuccaaaacuuugugcagugcccucugggagaguucuccaucucuccccggaauacaccuggcgaaauucuuuuugaucuggcccucgggccgggacugaaccccuaccuugcucaccugagcgccauguauacgggcugggucggcaauauggaggugcagcucguucuggcugggaacgccuucaccgcgggaaaaguggucguggcccugguuccucccuacuuuccuaagggcucccucacaaccgcucagaucacauguuucccccaugugaugugcgacguccgcacccuggaaccgauccaacuuccucugcucgaugugagacgggugcuguggcacgccacacaggaccaggaggagucuaugcgccuugucuguaugcuguauacgccccucagaaccaauagcccuggggaugaauccuuuguugugagcggacggcugcugucuaaacccgcugccgacuucaacuuuguguaccucacacccccuauugagcgcaccaucuauagaauggucgaucugccggugcuucagccccggcugugcacccaugcccgcuggccugcucccauuuacggccuccugguugacccuucccuucccagcaauccgcaauggcagaacgggagagugcacgucgauggaacacugcucggcaccacgccugugucuggcuccuggguuagcuguuucgcggccgaagcugccuaugaguuucagucugggacaggacaaguggccaccuucacacugaucgagcaggacggcuccgcuuacguccccggggaucgggccgcgccucugggauaccccgacuuuagcggccagcucgaaauugaggugcagaccgaaaccacaaaggcuggggacaaacugaaggucacgaccuucgagaugauccuuggaccuacaaccaauguggaucaagcccccuaucagggccgcguuuacgccucccuggcuguggccgcuucucucgaccuggucgauggcagagugcgggccguuccgcgcagcauucauggguuccaggacgugaucccugaauauaacgauggacuucuggucccccucgcgcccccuaucggcccguuucugcccggggaggugcugcucagauuccggacauacaugagacagcuggacaccgccgaugcugccgcugaggccauugacugcgcgcuuccucaagaauuuaucuccugguucgccagcaaugcuuuuacggugcagucugaugcccugcuccugcgcuaucggaacacacugaccggacagcuucucuucgaguguaagcuguacuccgaaggcuauauugcucugagcuacucugggagcggcccccucaccuuuccuacagacggauucuuugagguugucuccugggugcccagacuguuccagcuugccucugugggcagccuggccaccgggcgcacacucaaacaauga

SEQ ID NO: 28062 - RNA, 1626 nt, Artificial Sequence
  derived and/or modified sequence opt5 from capsid_protein__Norovirus__ABU55622
augagaaugagcgacggcgccacccccaaggcuaacggguccgaggccucuggacaggaucuggugccuacagcggucgaacaagcuguuccgauccagcccguggccggcgccgcucucgccgcuccugccgcggggcagauuaaucagaucgaccccuggauuuuccaaaacuuugugcagugcccucugggagaguucagcaucagcccccggaauacgccuggcgaaauucuuuuugaucuggcccucgggccgggacugaaccccuaccuugcucaccugucugccauguauaccggcugggucggcaauauggaggugcagcucguucuggcugggaacgccuucacagcgggaaaaguggucguggcccugguuccucccuacuuuccuaagggcagccucaccacagcucagaucaccuguuucccccaugugaugugcgacguccgcacacuggaaccgauccaacuuccucugcucgaugugagacgggugcuguggcacgccacccaggaccaggaggaguccaugcgccuugucuguaugcuguauacgccccucagaaccaauucuccuggggaugaauccuuuguuguguccggacggcugcugagcaaacccgcugccgacuucaacuuuguguaccucacacccccuauugagcgcaccaucuauagaauggucgaucugccggugauucagccccggcuuugcacacaugcccgcuggccugcucccguuuacggccugcucguggacccuucucugcccuccaauccgcaauggcagaacgggagaguccacguggauggaacccuucugggcacgacaccuaucagcggcucuuggguuuccuguuucgcggccgaagcugccuaugaguuucagagcgggaccggagagguggccacauucacccucauugaacaagacggcucugcuuacguccccggggaucgggccgcgccucugggauaccccgacuuuuccggccagcuggagaucgaagugcagaccgagacaacgaagaccggggacaaacucaaggucacaaccuucgaaaugauucugggaccuacaaccaauguggaucaggcucccuaucaaggccgcguuuucgccagcgugacggccgcugccucccuugaccuggucgauggcagagugcgggcuguuccgcgcucuaucuacggguuucaggacacaaucccugaguauaacgauggacuccuggugccccuugcgcccccuauuggcccguuccugcccggggagguccuccugagauuucggaccuacaugagacagcuggacaccgccgaugccgcugccgaagcuaucgacugcgcccucccucaggaguucgugagcugguuugcguccaaugccuucacagugcaaagcgaagcucugcuucugcgcuaucggaacacccucacaggacagcugcuguuugaguguaaacuuuacucugaaggcuauauugcccucuccuacagcgggucuggcagccugacguuccccaccgauggauuuuucgagguugucuccugggugccuagacuguaccagcucgcuucugugggcagccuggccacagggcgcacccuuaagcaguga

SEQ ID NO: 28063 - RNA, 1623 nt, Artificial Sequence
  derived and/or modified sequence opt5 from capsid_protein__Norovirus__ABU55628
augagaaugagcgacggcgccgugcccaaggcuaacggguccgaggccucuggacaggaucuggucccuaccgcgguugaacaagcugugccgauccagcccguggccggcgccagcauugcugccccugcugccgggcagaucaaucagauugaccccuggaucuuccaaaacuuuguccagugcccucucggagaguucuccauuucuccccggaauacaccuggcgaaauccuguuugaucuugcgcuggggccgggacucaaccccuaccuggcccaccuuagcgcuauguauacgggcugggugggcaauauggagguucagcuggugcucgccgggaacgcuuucaccgccggaaaagucgugguugcgcuggugccucccuacuuuccuaagggcucccugacaaccgcccagaucacauguuucccccaugucaugugcgacgugcgcacccucgaaccgauucaacugccucuucuggaugugagacggguccucuggcacgcuacacaggaccaggaggagucuaugcgccugguuuguaugcuuuauacgccccugagaaccaauagcccuggggaugaauccuuuguggugagcggacggcuccugucuaaacccgccgcugacuucaacuuugucuaccugacacccccuaucgagcgcaccauuuauagaaugguggaucucccgguucugcagccccggcuuugcacccaugcccgcuggccugcccccaucuacggccugcucguggacccuucccugcccagcaauccgcaauggcagaacgggagaguccacguggauggaacacuucugggcaccacgccuguuucuggcuccugggugagcuguuucgcugcggaagccgcuuaugaguuucagucugggacaggagaggucgccaccuucacacucauugaacaagacggcuccgccuacgugcccggggaucgggcugccccucugggauaccccgacuuuagcggccagcuggagaucgaaguccagaccgagaccacaaagacgggggaaaaacucaaggugaccacauucgagaugauucugggaccugcgaccaauguugaccaggcucccuuccaaggccgcguguaugccucccuuacagccgucgcuucucuggaucucguggacggcagaguucgggccgugccgcgcagcaucuacgcuuuucaggaugucaucccugaguauaacgacgggcugcuugugccccuggcgcccccuauuggaccguuccuccccggcgaacugcugcucagauuucggaccuacaugagacagaucgauuccagcgacgccgccgcugaggccauugauugcgcucugccucaggaguucaucucuugguuugccuccaaugcguucacggugcaaagcgaagcccuucugcuccgcuaucggaacacacugaccgggcagcugcuuuuugaauguaagcucuacucugagggauauauugcucugagcuacuccggcucugggccccugaccuucccugccgacggcuuuuucgagguugucagcugggugcccagacucuuucagcuggcuuccgugggaagcucugccacaggccgcacccuuaaauga

SEQ ID NO: 28064 - RNA, 1593 nt, Artificial Sequence
  derived and/or modified sequence opt5 from capsid_protein__Norovirus__ABW74121
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggucuggaacaggcgauuccuucguuguggcggggcgggugaugaccugcccuagccccgacuuuaauuuccuuuuucuggucccucccacaguggagcagaagacccgccccuucacgcucccuaaccugccgcugucuucccucagcaacucuagagcuccccugccuaucuccggaaugggcauuagccccgauaauguucaauccgugcaguuucagaacggccgguguacacuugacgggcgccuggucggaaccacaccugugucucucagccauguugccaaaaucagaggcaccuccaaugggaccgugauuaaccugacagaacuugacggaacgcccuuccacccguucgagggcccugcccccaucggguuuccugaucugggaggcugcgacuggcacaucaauaugacccaguucggccauagcucucaaacacaguacgaugucgacaccacacccgauaccuuugugccucaccucggguccauucaggcuaacggaaucaauagcggcaacuauauugggguccugucuugggugagcccgcccucccauccuucuggaagccaaguugaccuguggaagauccccaauuacggcuccagcauuacggaggccacacaccucgcccccucuguguucccuccgggguuuggcgaaguccugguguucuuuauguccaaaauccccggaccuggcgcuuauagccuucccugucugcucccucaggaguacaucucucaccuggcguccgaacaggcccccaccguuggggaggcugcccuucugcauuauguggauccugacaccggacggaaccucggcgaguucaaggccuaccccgauggguuucugacaugcgucccgaauggagcuagcuccggcccucagcaacugcccauuaacgggguguucguguuuguuucuugggucagccgcuucuaccagcucaagccugugggcaccgccuccacagcgagaggacggcugggccuucgcagauga

SEQ ID NO: 28065 - RNA, 1593 nt, Artificial Sequence
  derived and/or modified sequence opt5 from capsid_protein__Norovirus__ABW74123
augaugauggccagcaaggacgcuaccuccucuguggauggcgccagcggggcgggacagcugguccccgagguuaacgcuuccgacccucucgccauggauccgguggccggcucuagcacagcuguggccacggcugggcaagucaaucccaucgacccuuggauuaucaacaauuucgugcaggcgccccagggagaauuuaccauuuccccuaacaauacacccggcgauguucuguucgaccuuucucuggggccucaccucaacccguuucugcuucaucugagccagauguacaauggaugggugggcaacaugagaguccggaucaugcucgccggcaaugccuucaccgcugggaaaauuaucguguccugcauucccccuggauuuggcagccacaaccugacaaucgcccaagcuacccuguucccccauguuaucgccgaugugcgcacacucgacccuauugaggucccccuggaagaugugagaaaugugcuuuuucacaacaaugaccggaaccagcagaccaugcgccuggucuguaugcucuauacgccgcugagaaccgggggaggcacaggggauucuuucguuguggcgggacgggugaugaccugcccuucccccgacuuuaauuuccuuuuucuggucccucccacaguggagcagaagacccgccccuucacgcucccuaaccugccgcugagcucucucuccaacagcagagcuccccugccuaucucuggcaugggcauuucccccgauaauguucaaagcgugcaguuucagaacgggcgguguacacuugacggacgccuggucggcaccacaccugugucccucucucauguugccaaaaucagagggaccagcaauggaaccgugauuaaccugacagaacuugacggcacgcccuuccacccguucgaggggccugcccccaucggauuuccugaucugggcggcugcgacuggcacaucaauaugacccaguucgggcauuccagccaaacacaguacgaugucgacaccacacccgauaccuuugugccucaccucggaucuauucaggcuaacggcaucaauuccgggaacuauauuggaguccugagcugggugucucccccgagccauccuuccggcucucaaguugaccuguggaagauccccaauuacgggagcuccauuacggaggccacacaccucgcccccagcguguucccuccgggcuuuggagaaguccugguguucuuuaugucuaaaauccccggcccuggggcuuauucccuucccugucugcucccucaggaguacaucagccaccuggcgucugaacaggcccccaccguuggagaggcugcccuucugcauuauguggauccugacaccggccggaaccucggggaguucaaggccuaccccgauggauuucugacaugcgucccgaauggcgcuuccagcgggccucagcaacugcccauuaacggcguguucguguuuguuuccugggucucucgcuucuaccagcucaagccugugggaaccgccagcacagcgagaggccggcuggggcuucgcagauga

SEQ ID NO: 28066 - RNA, 1593 nt, Artificial Sequence; identical to SEQ ID NO: 28065
  derived and/or modified sequence opt5 from capsid_protein__Norovirus__ABW74124

SEQ ID NO: 28067 - RNA, 1593 nt, Artificial Sequence; identical to SEQ ID NO: 28065
  derived and/or modified sequence opt5 from capsid_protein__Norovirus__ABW74125

SEQ ID NO: 28068 - RNA, 1593 nt, Artificial Sequence; identical to SEQ ID NO: 28065
  derived and/or modified sequence opt5 from capsid_protein__Norovirus__ABW74126

SEQ ID NO: 28069 - RNA, 1593 nt, Artificial Sequence; identical to SEQ ID NO: 28065
  derived and/or modified sequence opt5 from capsid_protein__Norovirus__ABW74127

SEQ ID NO: 28070 - RNA, 1593 nt, Artificial Sequence; identical to SEQ ID NO: 28065
  derived and/or modified sequence opt5 from capsid_protein__Norovirus__ABW74128

SEQ ID NO: 28071 - RNA, 1620 nt, Artificial Sequence
  derived and/or modified sequence opt5 from capsid_protein__Norovirus__ABW74532
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacauuaucgacccuuggauuagaaauaacuucgugcaggcccccggcggggaauuuaccguuuccccucggaaugcgcccggagagauccuguggucugccccucuuggcccggaucugaaccccuaccucagccaccugucccgcauguauaauggguacgcuggaggcuucgaagugcaggucauucuugccggcaacgcuuuuacagccgggaaaaucaucuucgcggccgugccucccaauuuuccuacggagggacugucucccagccagguuaccauguucccgcaugugauugucgacgugagacaacucgagccugugcugaucccccugccugauguccggaacaauuuuuaucacuacaaccaggcucaugaccccacaauuaagcucaucgccaugcuguauacaccccuucgcgcuaauaacgccggcgaugacguuuucaccguguccugcagagugcugacccggccuagcccggauuuugacuucauuuuucucgugcccccuacagucgaaucucgcaccaaacccuucacgguuccuauccugaccguggaggaaauguccaacagcagauuucccauuccgcuugagaagcuguacacagggccuucuuccgauuucgucgugcagccccagaauggacgguguaccacagacggcguucuccuggggaccacgcaacugagcgccgugaacaucugcaauuucaaaggagaugucacacacaucgcuggcucucgcgacuauagaaugaaccucgugucccagaauuggaacaauuacgacccuaccgaggaaauucccgcgccucugggcacacccgauuuucaggggaagauccagggacuucugacccaaaccacaggcgccgacgggagcacgcgggcucauaaggccaccgucuccacaggagccgcuaacuucaccccgaaacucggcucugugcaguuuacaaccgauacggacaaugauuuccagacagggcaaaacaccaaguuuaccccuguuggagugauucaggacggcagccaccaccagaaugagccccagcaauggguccugcccaacuacuccggccgcacagugcauaauguucaccuugccccugcgguggcuccgaccuuccccggggaacagcugcucuuuuucagaagcacaaugccuggauguucuggcuaucccaacaugaaucuggauugccugcucccucaggagugggucaugcauuuuuaccaggaagccgcccccgcucaauccgacguggcccugcuucgguucgugaacccugauacggggcgcguucuguuugaguguaaacuccacaaggcuggauauaucaccgucgcccacacaggccagcaugaccuggugauucccccgaacggguacuucagauuugauagcugggugaaucaguucuauacccuugcgccuaugggcaacggagccggccggagacgcgcucuguga

SEQ ID NO: 28072 - RNA, 1620 nt, Artificial Sequence
  derived and/or modified sequence opt5 from capsid_protein__Norovirus__ABW74533
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagaggcgaugggagcacccgggcccauaaggccacagucuccaccggaucugugcacuucacgcccaagcugggcagcguucaauuuacaaccgacaccaauaacgauuuccagacagggcagaauaccaaauuuacaccggugggagucauucaagacggcgauaaccaccagaaugagccucagcagugggugcuccccaacuacuccggccgcacggggcauaauguucaccuggcccccgcuguggccccuaccuucccgggagaacaacuucuguuuuucagaagcacaaugcccggcuguucuggguauccuaacaugaaccucgacugccugcugccccaggaguggguccagcauuuuuaccaggaagcggcuccugcccaauccgauguggcccuccugcgguucgugaaucccgacaccggacgcguucuuuuugaguguaagcugcacaaaagcggcuaugucacaguggcucacaccgggccucaugaucucgugauucccccgaacggcuacuucagauuugacucuugggucaaucaguucuauacgcuggccccuaugggaaacggcaccgggcggagacgcgcucuuuga

SEQ ID NO: 28073 - RNA, 1623 nt, Artificial Sequence
  derived and/or modified sequence opt5 from capsid_protein__Norovirus__ABW74534
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgagacccuucaccguuccuauccugacaguggaggaaaugaccaauucccgguuucccauuccgcuugagaaacuguucacagggccuagcggagccuucgucgugcagccccagaacggccgcuguaccacggaugggguucuccugggaacaacccaacugucuccugugaauaucugcacauuuagaggcgacgucacccauaucgccggcacccacgauuacacaaugaaccucgcuucccagaauuggaacaauuaugaccccacggaggaaauuccugcgccccuggggaccccggacuucgugggaaagauccagggcguccuuagccagacaacccgcggggauggaucuacacggggccauaaagccaccguguccacggggagcguucacuuuacaccuaagcugggauccgugcaauucaccaccgacacaaacaaugaucucgagaccggccagaacacaaaguuuacgcccgucggcgugguucaggacggaaauucuacccaccaaaacgaaccccagcagugggugcugccuaauuacagcgggagaacaggccauaacguccaccuugcuccggccguggcccccaccuucccuggggagcagcugcucuuuuuccgguccacaaugcccggauguagcggcuacccuaauaugaaccuggauugccugcucccccaagaaugggugcagcauuuuuaucaggaggcugccccugcgcagucugacguugcucugcuucgcuucgucaaccccgauaccgggagagugcuguuugaguguaaacuccacaaguccggcuacgugacggucgcccacaccggacaacaugaccuggugauuccgccuaauggcuauuuccgguuugauagcuggguuaaccaguucuacacacuugcccccauggggaauggagcuggcagacgccgggcccuguga

SEQ ID NO: 28074 - RNA, 1623 nt, Artificial Sequence; identical to SEQ ID NO: 27964
  derived and/or modified sequence opt5 from capsid_protein__Norovirus__ABW74535

SEQ ID NO: 28075 - RNA, 1620 nt, Artificial Sequence
  derived and/or modified sequence opt5 from capsid_protein__Norovirus__ABW74536
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccagacgauccuugccggcaacgcuuuuaccgccgggaaaauuaucuucgcggccgugccucccaauuuuccuacagagggacugucccccucucagguuaccauguucccgcauaucauuguggacgucagacaacucgagccugugcugaucccccugccugaugugcggaacaauuuuuaucacuacaaccagagcaaugaccccacaauuaagcucaucgcuaugcuguauacaccccuucgcgccaacaacgcuggcgaugacgucuucaccguuuccugcagagugcugacccggccuagcccggauuuugacuucauuuuucucgugcccccuacggucgaaucucgcaccaaacccuucacagugccuauccugaccguugaggaaauguccaauagcagauuucccauuccgcuugagaagcuguacacagggccuucuuccgccuucgugguccagccccagaacggacgguguaccacggauggcgugcuccuggggacaacccaacugagcgccguuaauaucugcacauuccgcggagacgugacccauaucgcuggcucucacgauuauaccaugaaccucgcgucccagaauuggaacaauuacgacccuacagaggaaauucccgccccucugggcacgcccgacuuugucgggaaaauccagggaaugcuuacccagacaaccagagaggauggcagcacacgggcucauaaggccaccguguccacggggucuguccacuucacaccgaagcugggaagcgugcaauacaccaccgacacaaacaaugauuuucaggccggccagaacaccaaauucacaccuguuggggugauucaagacggaaauaaccaccagaaugaaccccagcaguggguccuccccaacuauuccggccgcacgggccauaaugugcaccuggcuccugccguugcgccgaccuuucccggggagcaacuucuguucuuuagaagcacaaugccuggauguucuggcuaccccaacaugaaccucgauugccugcugccucaggaaugggugcagcauuucuaucaggaggcugcccccgcccaauccgacgucgcucuccugcgguuugugaauccugauaccgggcgcgugcuuuucgaguguaagcugcacaaaagcggauacguuacagucgcccacaccggcccccaugaccucgugaucccgccuaacggguauuuuagauucgauucuugggugaaucaguuuuacacgcuggcucccaugggcaacggaaccggccggagacgcgcccuuuga

SEQ ID NO: 28076 - RNA, 1623 nt, Artificial Sequence
  derived and/or modified sequence opt5 from capsid_protein__Norovirus__ABW74537
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucaccguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauauccccggcaccagaacauaccggaugaaccucgccagccagaauuggaacaauuaugauccuacggaggaaauucccgcuccgcugggcaccccugacuucguggggaaaauccagggaaugcuuacacagaccacaaagggcgacgggucuacccgcggacacaaggcgacggucuccacaggcagcguggauuuuacccccaaacugggguccguucaauucgccaccgacacagauaacgacuuugagaccggacagaauacaagauucacgcccgugggcgucauucaggauggcucuagcgcucaucggaacgaaccucaacagugggugcucccggacuacuccgggcgcaccguucacaaugugcaccuggcccccgccgucgcuccuacauuucccggagagcagcuucuguucuuuagaagcaccaugccuggcuguucuggguaccccaacauggaucucgacugccugcugccucaggaaugggugcaacauuucuaucaggaggccgcgcccgcucaguccgauguggcccuccugcgguuuguuaauccggacacaggaagaguccuuuucgaguguaagcugcacaaaaccggcuacgugacgguggcccauaccgggcagcacgaucucgucaucccucccaacggcuauuuucgcuucgacagcugggugaaucaauucuacacacuggcuccuaugggaaacggcgccgggcggagacgcgcucuuuga

SEQ ID NO: 28077 - RNA, 1623 nt, Artificial Sequence
  derived and/or modified sequence opt5 from capsid_protein__Norovirus__ABW74538
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucagcucaacgaccccaccauuaagcugaucgcuaugcuuuauacaccccugcgcgccaauaacgcuggcgaugacguuuucaccguguccugcagagugcucacacggccuagcccggauuuugacuucauuuuucuggugcccccuaccgucgaaucucgcacgaaacccuucaccguuccuauccuuacaguggaggaaaugaccaacuccagauuucccauuccgcuggagaaacucuucacagggccuagcggagccuucgucgugcagccccagaauggccgguguaccacggaugggguucugcugggaacaacccaacucucuccugugaacaucugcacauuucgcggcgacgucacccauaucgccggcacccacgauuacacaaugaaucuggcuucccagaacuggaauaacuaugaccccacggaggaaauuccugcgccccuugggaccccggacuucgugggaaagauccagggcguccugacacagaccacaagaggggauggaagcacccggggccauaaggccacggugucuacaggguccguucacuuuaccccuaagcucggaagcgugcaauucaccacagacaccaauaacgaucuggagacaggccagaauacgcgcuuuacccccgucggcgugguucaggacgggaacuccacacaccaaaaugaaccccagcagugggugcuuccuaacuacucuggcagagcuggacauaauguccaccuggccccggccguggcucccaccuucccuggggagcagcuccuguuuuuccggagcacaaugcccggauguuccggcuacccuaacaugaaucuggauugccuccugccccaagaaugggugcagcauuuuuaucaggaggccgcgccugcucagagcgacguugcccuucugcgcuucgucaaccccgauaccgggagagugcucuuugaguguaaacugcacaagucuggcuacgugacggucgcccacaccggacaacaugaccuugugauuccgccuaacggcuauuuccgguuugauuccuggguuaaucaguucuacacacuggcucccauggggaacggagccggcagacgccgggcucucuga

SEQ ID NO: 28078 - RNA, 1623 nt, Artificial Sequence
  derived and/or modified sequence opt5 from capsid_protein__Norovirus__ABW74539
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcggagccuucgucgugcagccucagaauggccgguguaccacggaugggguucuccugggaacaacccaacugucucccgugaacaucugcacauuucgcggcgacgucacccauaucgccggcaccagaaauuacacaaugaaccucgcuucccagaauuggaacaauuaugauccuacggaggaaauucccgcgccucuggggacccccgacuucgugggacggauccagggcaugcuuacacagaccacacgcagagacgggagcacccggggacacaaagccacggucucuacaggcgaugcucauuuuaccccgaagcugggguccauuauguucagcaccgacacagauaacgacuuugagaccggacaaaauacaaaguucacgccugugggcguugugcaggauggcaacgggacccaccagaaugaaccccaacaguggguccuccccuccuacucuggacgcacaggccacaacgugcaucuggccccugccguugcuccgaccuuucccggggagcagcuucuguucuuuagaagcacaaugccuggauguuccggcuaccccaauaugaaccucgacugccugcugccucaggaaugggugcaacacuucuaucaggaggccgcgcccgcucagagcgaugucgcccuccugcgguuugugaacccugacaccgggagagugcuuuucgaguguaaacugcauaagucuggcuacguuacggucgcccacaccggacagcacgaucucgugauucccccgaauggcuauuuucgcuucgacuccugggugaaccaauucuacacacuggcuccuauggggaauggaaccggccggagacgcgcccuuuga

SEQ ID NO: 28079 - RNA, 1623 nt, Artificial Sequence; identical to SEQ ID NO: 26947
  derived and/or modified sequence opt5 from capsid_protein__Norovirus__ABW74540

SEQ ID NO: 28080 - RNA, 1623 nt, Artificial Sequence
  derived and/or modified sequence opt5 from capsid_protein__Norovirus__ABW74541
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuucuagcuccuucgucgugcagccccagaacggacgguguaccacggauggcguucuccuggggacaacccaacugagcccugugaauaucugcacauuucgcggagacgucacccauaucgccggcacccagaacuacacaaugaaucucgccucucagaacuggaauaacuaugaucccacggaggaaauuccugcuccccugggcaccccggacuucguggggaaaauccagggaguccuuacacaaaccacaagaggcgacggguccacccggggacacaaggcgacggugagcacaggcuccguucauuuuaccccuaagcuggggucugugcaguucagcaccgauacauccaaugacuuugagaccggacagaacacacgcuucacgcccgucggcgugguucaagauggcagcaccacacaccagaaugaaccccagcagugggugcucccugacuacucugggagaaacucccacaauguccaucuggccccggcuguggcccccaccuuuccuggagagcaacuucuguucuuucggagcacaaugcccggcuguucuggguacccuaacaugaaucucgauugccugcugccccaggaaugggugcagcacuucuaucaggagagcgccccugcucaauccgacguugcccuccugcgcuuugucaaccccgauaccggaagagugcuuuucgaguguaaacugcauaagucuggcuacgugacggucgcgcacaccgggcagcacgaccucgugauuccgccuaacggcuauuuucgguucgauagcuggguuaaucaguucuacacacuggcucccaugggaaacggcgccgggagacgccgggcccuuuga

SEQ ID NO: 28081 - RNA, 1623 nt, Artificial Sequence
  derived and/or modified sequence opt5 from capsid_protein__Norovirus__ABW74542
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucuccguucccauccugacgguggaagagaugaccaacagcagauuuccuauuccccuugagaagcuguucacagggccgucuuccgccuucgucgugcagccucagaauggacgguguaccacagacggcguucuccuggggaccacgcaacugagccccgugaacaucugcacauuucgcggagaugucacccauaucgcuggcacacaggaauacaccaugaaucucgcgucucagaacuggaauaacuaugacccuaccgaggaaauucccgccccucugggcacacccgauuucguggggaaaauccagggaguccuuacgcaaaccacaagacgggacggcuccacccgcgggcacaaggcuacagugagcaccggauccguucauuuuacgccgaagcugggcagaauccaguucucuacagacaccagcaaugauuuugagaccgggcagaacacacgguucaccccugugggagucgugcaagacggcuccacaacgcaccagaaugaaccccagcaguggguucuccccaacuacagcggccgcgauucucacaaugugcaucuggccccugccgucgcuccguccuuucccggggagcaacuucuguucuuuagaagcaccaugccuggauguucuggcuaccccaacauggaccucgauugccugcugccucaggagugggugcagcacuucuaucaggaagccgcgcccgcucaaagcgacguggcccuccugcgguuuguuaauccugauacagggagaguccuuuucgaguguaaacugcauaaguccggauacgugaccguggcccacacaggccagcacgaccucgucauucccccgaacggguauuuucgcuucgauucuugggugaaccaguucuacacccuggcuccuaugggcaauggaacgggccggagacgcgcccuuuga

SEQ ID NO: 28082 - RNA, 1623 nt, Artificial Sequence; identical to SEQ ID NO: 26932
  derived and/or modified sequence opt5 from capsid_protein__Norovirus__ABW74544

SEQ ID NO: 28083 - RNA, 1623 nt, Artificial Sequence; identical to SEQ ID NO: 27495
  derived and/or modified sequence opt5 from capsid_protein__Norovirus__ABW74545

SEQ ID NO: 28084 - RNA, 1623 nt, Artificial Sequence
  derived and/or modified sequence opt5 from capsid_protein__Norovirus__ABW74546
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcagcacaacgcaccgcaacgaaccccagcaaugggugcugccuuccuacagcggcagaaauguucacaacgugcaucuugccccggcugucgcccccaccuuuccuggggagcagcuccuguucuuucggucuacaaugcccggauguuccggcuauccuaauauggaucuggacugccugcucccccaggagugggugcagcacuuccaucaagaagcggcuccugcccagagcgauguggcccugcuucgcuuuguuaaccccgacaccgggagaguccuguucgaguguaaacuccacaagucuggauacgugacaguggcucacaccggccagcaugaucuggucaucccgccuaacggguauuuucgguucgacagcugggugaaucaguucuacacgcuugcccccaugggcaacggaaccggcagacgccgggcucuguga

SEQ ID NO: 28085 - RNA, 1566 nt, Artificial Sequence
  derived and/or modified sequence opt5 from capsid_protein__Norovirus__ABW75843
augaagaugagcgacaaagaguccgccgaaucucccgcuagccugggccaggugcucccuccgcaagucgauguuguggugcccgucgagccuaccgugggggcccagaucgcggcucccacagccggacagauuaacccuaucgaccccuggauuuucuccaauuuuguucaggccccucaaggcgaguucacgaucucuccgaacaauaaccccggggagauucuguuugaaauggagcuuggaccugaucugaaucccuaccucggccaccugagacggauguauaacggguggaccggaagccuucgcgugagagucaugcuggcuggcaaugccuucuccgcuggcaagaucaucguguuuugcauuccucccggguucgacacaaccuuucucacaccggcccaggcgacccaguucccucauguuaucauggaugugcgggcccccgacccugucgaggugccccuggaagaugugcgcaacguccuguuucaccagggacccgacaauagaaugcggcucguuggcaugcuguacacaccucuucgcgcuaacucuggggccgauccguucguggugaccggaagaguccugacgugucccagcgagaauuuuuccuucuuuuuccucgugccucccaccguugaagagaaagacgugccuuucacaauucccaacgucccgaccagcucucugacaaauucccggaugcuugagccuguggcugaacugcgcagcucuagaaacuuugcccucuccguucaauuccagaauggccggagcaccaucgagggggaacugcugggaacgacacccgcgucucucgccgaucugggcuccuuucuuugcauucgcggcgggaccgcuaaccuggccgaacucuuccagccuaacgaagacgcuuuuguggccggaagccaucccgccccuuucggcuuucccgauuucuccaauuguacacuggacuuucuucuguaugacgcuaacgggcucuaccacagacaucuggaugucaccucugcgagcaauuucaccccggcccugggacacaucacacucgacggcuccgugccugaucggcugacgcgcgcuagacuugaggggguccagcgggccagcgagaacaccuuuuggagaaugcccgacuaucgcggagaugugcugggcgccgaguucgcucccgccguuucugcgccuggcauuggggaaacacuccuguuuuucauguccaaugugccguaccacaacggaagcaaucccaacccucuucccugccugcucccucuggaauggaucaaucauuucgucgcugagcggcccgccaagcaaucugacguggcccugcucaacuauaucaauccucugaccggcagaguucuuuuugaauguaaacuguacagcgcuggguuccucgccgugaaccugggaucccagacagaggucacccugcccguggauggcauuuuuaaguucgugucuuggguuagcuacuauuaccagcuucgcccggucgggacgguguccgugggccggagacucccucgccuggacggacacuga

SEQ ID NO: 28086 - RNA, 1737 nt, Artificial Sequence
  derived and/or modified sequence opt5 from capsid_protein__Norovirus__ABX71062
augaagauggccagcaacgacgcugcccccuccucugauggcgcggggaaucuggugccugagagccaccaggaaguccucccgcuggcucccguugccggagccgcuaucgccgcuccuguggugggccaacagaacauuaucgaccccuggauuaaagagaauuucguccaggccccucagggggaauuuaccgugucccccaagaacucuccuggagagguucuugugaaucuggaacucagcccgaaacugaaccccuaccuugaucaucuguccaagauguauaaugcguacgccggcgggauggagaucgagauuauccucgcuggaaacgccuucacagcuggcaaaguccugaucgccgcggugccucccaauuuuccuguugaaaacauuucugugagccaagccucccaguucccccacgucaucguggacgugagaacgcuggagccgauucggcucccucugcccgauguccgcaccaacuuuuuccauuauacaaccagagacgaaccuaagaugcggaucguugcuuggcuuuacacaccccugcgcaccaauggcagcggggaugacucuuuuacaguguccggacggauucucaccagacccagcgccgauuucgaguuuucuuuccuggugccuccgacggucgagaccaagacaguguccuuuagcguucccggccuuaccguggaagagaugucuaauucccgcuggccugcucagaucaacgggcuggucgugagaggaaaugaagcccagguugugcacuuccaaaacggccggugcacaaccgaggggaugcuccugggaacgacaacccugaacgucaauagcauuuguggccuccgcggcacauccaucucucaugccagcgugagagaagcucccgcgcuguccgaggagaugccuccccuugaagacgaggucgcccacggggcugccgccaccuaugcugugggacgggccgcggauaccacacuguggauccgcguugaggaaccgaacggccagccuuacgacauuuuuggggaacagcccgcuccucucggaacgcccgauuucaccgccgugaucauuggcacagccaucagaccucggaccgcuagcggggccuaucugcacgacgcuuacgucgacacacgccccggagaugccgacuucaccccgucuacgggcaauacaaaaauugugcuuagaggcgggggauccggccauguuggggagggacacuacuggcaguuuaagccuaucgcgguggagggcgggcccaaccggcccgucuaucaagaauacaaucugccugaguaugccggcccgaccgcuagcaaccauaaucucgcucccccuguggcucccaaaaugccuggagaacugcugcuccuguucgagucugauaugcccgugugggacaacggcagcggguccgccccuacccagaagauccacugccuucugcccaaugauuuuguuacacacuucuuugaccuccaggcgccggcccuggcugaagccgcccuucugagauacguccauccugauucuggacgcacccucuucgaguguaaacuguaucgggagggcuacauggugguggucgcccccagcgggagacuggacuuuccucucgauggauauuuccgcuuugacuccugggugaacgccuucuacguucugagccccgugggcaaugggcaaggccggagaggacgcgcuaagaacauuuga

SEQ ID NO: 28087 - RNA, 1605 nt, Artificial Sequence
  derived and/or modified sequence opt5 from capsid_protein__Norovirus__ABY77754
augaagauggccagcaacgacgcuucccccucuagcgauggcuccgccaaucuggugccugagaucaacaaugaagucauggcgcucgagccgguugcuggggccgccauugcugcccccguggcuggacagcaaaacaucauugacccuuggaucagaaauaacuucgugcaggcccccggcggggaauuuaccgucucuccucggaaugcgcccggagaggugcugcuuaaccugccucucagcccggauauuaaucccuaccuggcccaccuuucccgcauguauaacggcuacgcugggggaguugaaguggaggucgugcuggccggcaaugcuuucacagccggcaaaaucaucuuugcggccguuccucccaacuucccucccgagaaucucucuccgagccagauuacgaugcugccucauaucauuguggacgucagacagcuggaacccgugcggaucccucuccccgaugugcgcaacaauuuuuaucacuacuccagagagaacgacagcacccugcggcuugucgcuaugcuguauacaccccuccgcgccaacaaugcuggggaugacguuuucaccgugucuugcagagugcugacacggccuuccccggauuuugacuucauuuuucuugugcccccuaccgucgaaagcaagucuaaacccuucacaaucccuauucugaccaucgaggagaugacgaacucccgcuuucccgccccgcucgaaaugaugaccacaggaccuagccaugauaucguugugcaaccccagaauggcagauguaccauugacgggguccugcugggaacaacccagcucucuccugugaacaucugcuccaugcggggcguucccacgaagcgcacaaaugggaccgauaacuguuucgugcagcuggagaauccuaacggaagcgccuacgaccccacagaagacauuccggcuguccuuggcuccccugauuuugugggcgaguucuaugggaccaucacccaaagaucucccaauaacagcacacgggcgcaccccuucacgcugaauaccggauccccucgcuacacaccgaaaauuggcagcgucgacauccaugugaccgauguugacgaucucaacgaccacgaacccgugaagcugacaccugucgggcuuucuggauccagcggcucuauccaccaguggcagcugcccaauuacagcgggguggccacccauaacaugcaccucgcuccuuccguugcuccccuguuuccuggagagcagauucuguucuuuagaucuacggugcccggcugcggcggguauccgaauacaaacaucgauugucucauuccucaagaguggguccagcauuucuaccaggaaggagcccccgcccggaccgacguggcccugcuuagauuuaucaacccugauaccggccgcgugcuguucgagugcaagcuccacaaacacggguuuauuacaguugcguauagcggaaaucaugaccuggucaugcccccgaacggcuacuuccgguuugaauccugggugaaucaauuccacacccuugcuccuauggggacaggcagagccgaggaaauccaguga

SEQ ID NO: 28088 - RNA, 1608 nt, Artificial Sequence
  derived and/or modified sequence opt5 from capsid_protein__Norovirus__ABZ89549
augaagauggccagcaacgacgcuucccccucuagcgauggcuccgccaaucuggugccugagaucaacaaugaagucauggcgcucgagccgguugcuggggccgccauugcugcccccguggcuggacagcaaaacaucauugacccuuggaucagaaauaacuucgugcaggcccccggcggggaauuuaccgucucuccucggaaugcgcccggagaggugcugcuuaaccugccucucagcccggauauuaaucccuaccuggcccaccuuucccgcauguauaacggcuacgcugggggaguugaaguggaggucgugcuggccggcaaugcuuucacagccggcaaaaucaucuuugcggccguuccucccaacuucccucccgagaaucucucuccgagccagauuacgaugcugccucauaucauuguggacgucagacagcuggaacccgugcggaucccucuccccgaugugcgcaacaauuuuuaucacuacuccagagagaacgacagcacccugcggcuuauugcuaugcuguauacaccccuccgcgccaacaaugcuggggaugacgucuucaccguuucuugcagagugcugacacggccuuccccggauuuugacuucaucuuucuugugcccccuaccgucgaaagcaagucuaaacccuucacaauuccuauccugaccaucgaggagaugacgaacucccgcuuucccgccccgcucgaaaugaugaccacaggaccuagccaugauauugugguucaaccccagaauggcagauguaccaucgacggggugcugcugggaacaacccagcucucuccugucaacauuugcuccaugcggggcgugcccacgaagcgcacaaaugggaccgauaacuguuucguucagcuggagaauccuaacggaagcgccuacgaccccacagaagacaucccggcugugcuuggcuccccugauuuugucggcgaguucuaugggaccauuacccaaagaucucccaauaacagcacacgggcgcaccccuucacgcugaauaccggauccccucgcuacacaccgaaaaucggcagcguggacauccaugucaccgauguggaagaccucaacgaucacgagcccguuaagcugacaccuguggggcuuucuggauccagcggcucuauucaccaguggcagcugcccaauuacagcggggucgccacccauaacaugcaccucgcuccuuccguggcuccccuguuuccuggagagcagauccuguucuuuagaucuacgguucccggcugcggcggguauccgaauacaaacauugacugucucaucccucaagaaugggugcagcauuucuaccaggagggagcccccgcccggaccgaugucgcccugcuuagauuugugaacccugacaccggccgcgugcuguucgaaugcaagcuccacaaacacggguuuauuacaguugcguauagcggaaaucaugaucuggucaugcccccgaacggcuacuuccgguuugaguccugggugaaucaauuccacacccuugcuccuauggggacaggcagcggaagacgccggauccaguga

SEQ ID NO: 28089 - RNA, 1644 nt, Artificial Sequence
  derived and/or modified sequence opt5 from capsid_protein__Norovirus__ACC69023
augaagauggccagcaacgacgcucccccuuccaccgauggcucugccgggcuggugccggaggucaauaacgaaacaauggcgcucgagcccguugugggagcuccucuggccgcccccguggcuggccagcacaauaucauugacccuuggaucaaaaugaacuucguccaagcccccaauggggaauuuacggugagcccuagaaacgcuccgggagagauucuucuggaucucgaacugggccccgaccuuaauccuuaccugucccaucucgcccggauguauaacggguacgcgggaggcauggaggcccagguugugcuggcuggcaaugccuucaccgcugggaagaucauuuuugccgcggugcccccuaacuuccccgccgagaaucugucugcugcccaggucacaaugugcccgcacguuaucguggauguccgccagcucgaaccugugaugcugcccaugccugacaucagaaacaaacuuuuucauuauaaucaaguggaugaccccaagcugcggcuccuggcuuaccuuuauacaccccugcgcgccaacaaugccggagaugacgucuucaccguuagcuguagagugcucacccggccuacaccggauuuugaguucauguuucuggugcccccuaccgucgaauccaaaacgaagcccuucucucugccuggccucacccuggacgagcuuagcaacucccgcuuucccgcuccgauugugcagcuguacacaaacccucacgauaaucucguugugcagccccagaacgggagaugcaccaucgacggacugcuucaaggcacaacccagcuggucagcuguaaugugugcucuuaucgggggacgauuggaggcggccagccugcgucccauacagaggaagagaucaugcccauggccuucaacauucagcgcgaaaucaugcucgagaaucuggacgggagcccuuacgaucccguugacgauauuccggcugugcugggaucuccugacuuucaaggcgucguguucgggauccucucccagagaaacgccaauggacagacccgggcccacgaagcuaaggucgauacacgcgccgcgagauucgcucccaaacugggcuuugugguugccaccguggagagcaccgacuuccacgauaaccaacccucucgguuugccccugucgggcuuggaggcaauggcaaccaggacuucaaucagugggcucugccggccuacgggggagcucucacaaacaauacgaaccuggcgcccccugugaugcccguuuauccuggcgagcagcuucuguuuuuccgcucccaacuccccagcuccgggggaguggucggcggguggcuggauugucugcucccucaggaaugggugcagcacuuuuuccaggagucugccaccagccaauccgacguggcccugguuagauacaucaaucccacaaccggccggguccuuuuugaagcuaagcugcauaaacagggauuccucacaguggccgcuagcggcucuuauccgcugguggucccugccgauggguacuuuagauucgaguccugggugaaccaguuuuauacccuggcgcccaugggaaacggcagcgggcgccggagagcccgcuga

SEQ ID NO: 28090 - RNA, 1644 nt, Artificial Sequence
  derived and/or modified sequence opt5 from capsid_protein__Norovirus__ACC69026
augaagauggccagcaacgacgcucccccuuccaccgauggcucugccgggcuggugccggaggucaauaacgaaacaauggcgcucgagcccguugugggagcuccucuggccgcccccguggcuggccagcacaauaucauugacccuuggaucaaaaugaacuucguccaagcccccaauggggaauuuacggugagcccuagaaacgcuccgggagagauucuucuggaucucgaacugggccccgaccuuaauccuuaccugucccaucucgcccggauguauaacggguacgcgggaggcauggagguucaggugguccuggccggcaaugcuuucaccgccgggaagaucauuuuugcugccgugcccccuaacuuccccgcggagaaucugucugccgcucagguuacaaugugcccgcacgugaucgucgaugugcgccagcucgaaccugugaugcugcccaugccugacaucagaaacaaacuuuuucauuauaaucaagucgaugaccccaagcugcggcuccuggccuaccuuuauacaccccugcgcgcuaacaaugccggagaugacguuuucaccgugagcuguagagugcucacccggccuacaccggauuuugaguucauguuucuggugcccccuaccgucgaauccaaaacgaagcccuucucucugccuggccucacccuggacgagcuuagcaacucccgcuuucccgccccgauuguucagcuguacacaaacccucacgauaaucucgugguccagccccagaacgggagaugcaccaucgacggacugcuucaaggcacaacccagcuggugagcuguaauguuugcucuuuccgggggacgauuggaggcggccagccugcuucccauagcgaggaagagaucaugcccauggcguuuaacauucagcgcgaaaucaugcucgagaaucuggacgggucuccuuaugaucccgccgacgauauuccggcugugcugggauccccugacuuccaaggcgucguguucgggauccucagccagagaaacgccucuggacagacacgggcccacgaagcuaaggucgauacccgcgccgcgagauuugcucccaaacugggcuucgugguugccacaguggaguccaccgacuuucacgauaaucaacccagccgguucaccccugucgggcuuggaggcaacggcaaucaggacuuuaaccagugggcccugccggcuuacgggggagcccucacaaauaacacgaaucuggcucccccugugaugcccguuuacccuggcgagcagcuucuguucuuucgcucccaacuccccucuagcgggggaguggucggcggguggcuggauugucugcucccucaggaaugggugcagcauuucuuucaggaguccgccaccagccaaucugacguggcgcugguuagauauaucaaccccacaaccggccggguccuuuucgaagccaagcugcacaaacagggauuucucacaguggcugccuccggcagcuacccgcugguggucccugcugauggguauuucagauuugagucuugggugaaucaguucuacacccuggcccccaugggaaacggcagcgggcgccggagagcgcgcuga

SEQ ID NO: 28091 - RNA, 1671 nt, Artificial Sequence
  derived and/or modified sequence opt5 from capsid_protein__Norovirus__ACC69028
augaagauggccagcaacgacguggcugcccccuccaccgauggcucugcggggcuggucccugagguuaauaacgaaacaauggcucucgagccgguggccggagccgcucuggccgcucccguggucggccagcacaaugugaucgacccuuggauuagagggaacuucguucaagcccccaauggagaauuuacggugagcccucggaacucccccggcgagguccuucugaaucucgaacuggggccugagcuuaacccguaccuggcgcaucucgcccgcauguauaauggauacgcuggcggcauggaggugcagguugugcuggccgggaacgcuuucgccgcgggaaaaaucauuuuugccgcugugcccccuucuuuccccgucgaugcccugagcgcuccuaccaucacaaugugcccccacgugauugucgacguuagacagcucgaaccggugcugcuuccuaugcccgaugugcggaauaacuuuuuccauuauaaucaguccucugacccuaagcugcgccucgucgccaugcuguacacaccccuuagagccaacagccccaccgaugacguguuuaccguuuccugucgggugcugacacgcccuagcccggauuucgaguuuaccuuccucauucccccuacggucgaaucuaaauccaagccccugaccaucccucaacugacacucagcgagcugucuaauuccagauuucccgcuccgaucgacaugcuuaacaccagcccuaacgauaauaucgugguucagccccagaacggccggugcacacuggacggggagcuccagggaaccacgcaacugcagccuucucuuauuuguuccuuccgcggcgugguccugaaugaaacaagcagaauggcgguggauuaugaggaagaggaagagguccagcggccccaggcccgcgcuuuuaaccacgaguaccaucuccaacugcagaaucuggacgggaccgacuaugauccugccggagaccuccccgccacacugggcgcuccggauuucgugggcaccguuuacgggguggucucccagagaaccacacgggacucugccgcgcgcgcucacgaagccaaaaucauuacgaacgauccuagauacgcccccaagcugggaagcguggaguucguuaccgaauccacagacaucgugauuaaugaucaaaccaaguuuacacccgucggccuggcucacaaccgggccguggacuauaaacagugggagcucccucauuacgcuggggaacugaccgccaauacgaaccuugcgccgcccguggccccuguuuaucccggagagcagcuucucuucuuuagaagcaaucugccucuggcuggcgggacagccgcuucuguccucgauuaccugcuuccccaggaguggauccaacacuucuaucaggaauccuuuaccccucagagcgacaucgcccugcuccgcuacgugaaccccgauaccggacgggugcuguucgaggcgaagcugcauagacagggcuauauuacagucgccggcgcugggaccucuccgguggccguuccucccaauggauacuuucgcuucgaaagcugggugucccaauuuuacgcucuugccccuaugggcucugggacaggacggagacgcaaccaguga

SEQ ID NO: 28092 - RNA, 1626 nt, Artificial Sequence
  derived and/or modified sequence opt5 from capsid_protein__Norovirus__ACC96732
augggcaugagcgacggggccgcucccaaggccaacggauccgaggcgucuggccaggaucuggugccuaccgcugucgaacaagccguuccgauccagcccguggccggggcugcccucgcugccccugcggccggacagauuaaucagaucgaccccuggauuuuccaaaacuuugugcagugcccucugggcgaguucagcaucucccccagaaauacaccuggggaaauucuuuuugaucuggcucucggaccgggccugaaccccuaccuugcccaccugucugcuauguauacgggcugggucgggaauauggaggugcagcucguucuggccggaaacgcguucaccgccggcaaaguggucguggcucugguuccucccuacuuuccuaaggggagccucacaaccgcccagaucacauguuucccccaugugaugugcgacguccggacccuggaaccgauccaacuuccucugcucgaugugcgcagagugcuguggcacgcuacacaggaccaggaggaguccaugcggcuugucuguaugcuguauacgccccuccgcaccaauucuccuggagaugagagcuuuguuguguccggcagacugcugagcaaacccgccgccgacuucaacuuuguguaccucacacccccuauugaacggaccaucuaucgcauggucgaucugccggugauucagcccagacuuugcacccgggcucgcuggccugcgcccguuuacgggcugcucguggacccuucucugcccuccaauccgcaauggcagaacggaagaguccauguggauggcacacuucugggcaccacgccuaucagcgggucuuggguuuccuguuucgccgcugaagccgccuaugaguuucggagcggaacaggcgaggaagugaccuucacacucauugagcaggacgggucugcuuacguccccggagaucgcgccgcgccucugggcuaccccgacuuuuccgggcaacuggaaaucgaggugcagaccgaaaccacaaagacgggagacaaacucaaggucaccacauucgagaugauucugggcccuagaaccaauguggaucaggcucccuaucagggccgggccuacgccagcguuaacgcuacagccucccuuaaucugguggacgggcgcgucagagcugugccgcggucuauccacagcuuccaagauguuaucccugaguauaacgacggacuccuggugccccuugcgcccccuauuggcccguuucugcccuccgaaguccuccugagauuccgcaccuacaugcggcagaucgauacggccgacgccgcugccgaggcuauugauugcgcccugccucaggaauuugugagcugguucgcgucuaaugccuuuacagugcaguccgaggcucuccugcuuagauaucgcaacacccugaccgggcaacuccuguucgaauguaagcuguacagcgagggauauaucgcccuuucuuacagcggcuccgggccccucacauuuccuaccgacggcuucuuugagguugucucuugggugccccggcuguaccagcuggcuagcgugggaucccucgccacaggcagaacgcugaaacaguga

SEQ ID NO: 28093 - RNA, 1626 nt, Artificial Sequence
  derived and/or modified sequence opt5 from capsid_protein__Norovirus__ACC96735
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccucgcggcagccucacaaccacacagaucaccuguuucccccaugugaugugcgacgucagaacacuggaaccgauccaacuuccucugcucgaugugcggcgcgugcuguggcacgccacccaggaccaggaggaguccaugagacuugucuguaugcuguauacgccccuccggaccaauucuccuggggaugaauccuuuguuguguccggacgccugcugagcaagcccgcugccgacuucaacuuuguguaccucacacccccuauugagagaaccaucuaucggauggucgaucugccggugguucagccccgccuuugcacacaugccagauggccugcucccauuuacggccugcucguggacccuucucugcccuccaauccgcaauggcagaacgggcggguccacguggauggaacccuucugggcacgacaccuaucagcggcucuuggguuuccuguuucgcggccgaagcugccuaugaguuucagagcgggaccggagagguggccacauucacccucauugaacaagacggcucugcuuacguccccggggaucgcgccgcgccucugggauaccccgacuuuuccggccagcuggagaucgaagugcagaccgagacaacgaaaaccggggacaagcucaaagucacaaccuucgaaaugauucugggaccugagacaaaugaggaucaggcucccuaucaaggcagaguguucgccagcaucuccgccgcugccucucuugaccugguugauggccgggugcgcgcugucccgagaagcaucuacggguuucaggacgugauuccugaauauaacgauggacuccugguuccccuugcgcccccuaucggcccguuccugcccggggaggugcuccugcgguuuagaaccuacaugcgccaggucgacacgcaggaugccgccgcugaagccauugacugcgcucugccucaagaguucguguccugguuugccagcaaugcguucacagugcagucugaagcccuccugcuucgguauagaaacacccugaccggacagcuccuguuugaguguaagcuguacuccgagggcuauaucgcucuuagcuacucugggcccggcccucucacauuccccagcaauggauuuuucgaaguugucuccugggugccucgccuguaccagcuggccucugugggcagccucgcuaccgggcggacacugaagcaauga

SEQ ID NO: 28094 - RNA, 1623 nt, Artificial Sequence
  derived and/or modified sequence opt5 from capsid_protein__Norovirus__ACF41177
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcucugccuucgucgugcagccucagaauggacgguguaccacggauggcguucuccuggggacaacccaacugucccccgugaacaucugcagcuuucgcggagacgucacacauaucccuggcaccagaaccuaccggaugaaucucgccucucagaacuggaauaacuaugaucccacagaggaaauuccugcuccccugggcacgccggacuucguggggaaaauccagggaaugcuuacccagacaaccaagggcgacggguccacacgcggacacaaggcgaccgucagcacgggcuccguggauuuuacaccuaaacuggggucuguucaauucgccaccgacaccgauaaugacuuugagacaggacagaacaccagauucacacccgugggcgucauucaggauggcagcuccacgcaucggaaugaaccccaacagugggugcucccugacuacagcgggcgcaccguucacaacgugcaccuggcuccggccgucgcccccacauuuccuggagagcagcuucuguucuuuagaucuaccaugcccggcuguuccggguacccuaauauggaucucgacugccugcugccccaggaaugggugcaacauuucuaucaggaggcugccccuagccagucugauguggcgcuccugcgguuuguuaaccccgacacaggaagaguccuuuucgaguguaagcugcacaaagcuggcuacgugaccguggcccauacggggcagcacgaucucgucaucccgccuaauggcuauuuucgcuucgacagcugggugaaccaauucuacacccuggcccccaugggaaacggcgcugggcggagacgcgccuccuga

SEQ ID NO: 28095 - RNA, 1623 nt, Artificial Sequence
  derived and/or modified sequence opt5 from capsid_protein__Norovirus__ACF41180
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaaagagagacggcucuacccgggggcacaaggccacgguguccacaggaagcguucauuuuaccccuaaacugggcuccgugcaguucucuaccgauacaagcaaugacuuugagauugggcagaacacccgcuucacacccgucggagugguucaagauggcuccacgacccaccagaaugaaccccagcagugggugcucccuaacuacagcggcagagacgggcacaauguccaucuggcuccggccguggcccccacauuuccuggagagcaacuucuguucuuucggucuaccaugcccggcuguuccggguacccuaacaugaaucucgauugccugcugccccaggaaugggugcagcacuucuaucaggagagcgcuccugcccaaucugacguugcgcuccugcgcuuugucaaccccgauacaggcagagcucuuuucgaguguaagcugcauaaaagcggauacgugaccguggcccacacggggcagcacgaccucgucaucccgccuaacggcuauuuucgguucgauuccugggugaaucaguucuacacccuggcccccaugggaaacggcgcugggagacgccgggcccuuuga

SEQ ID NO: 28096 - RNA, 1623 nt, Artificial Sequence
  derived and/or modified sequence opt5 from capsid_protein__Norovirus__ACF41181
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaaugaccaacuccagauuuccuauuccccuugagaagcuguucacagggccgagcucugccuucgucgugcagccucagaauggacgguguaccacggauggcguucuccuggggacaacccaacugucccccgugaacaucugcacauuucgcggagacgucacccauaucccuggcaccagaacauaccggaugaaucucgccagccagaacuggaauaacuaugaucccacggaggaaauuccugcuccccugggcaccccggacuucguggggaaaauccagggaaugcuuccucagacaaccaagggcgacgggucuacacgcggacacaaggcgaccgucuccacgggcagcguggauuuuacacccaaacugggguccguucaauucgccaccgacaccgauaaugacuuugagacaggacagaacaccagauucacacccgugggcgucauucaggauggcucuagcacgcaucggaaugaaccucaacagugggugcucccggacuacuccgggcgcaccguuuacaacgugcaccuggcucccgccgucgccccuacauuucccggagagcagcuucuguucuuuagaagcaccaugccuggcuguucuggguaucccaauauggaucucgacugccugcugccucaggaaugggugcaacacuucuaccaggaggcugcccccucccagagcgauguggcgcuccugcgguuuguuaacccggacacaggaagaguccuuuucgaguguaagcugcauaaagcuggcuaugugaccguggcccacacggggcagcaugaucucgucaucccucccaauggcuacuuucgcuucgacucuugggugaaccaauucuauacccuggccccuaugggaaacggcgcugggcggagacgcgcccuuuga

SEQ ID NO: 28097 - RNA, 1623 nt, Artificial Sequence
  derived and/or modified sequence opt5 from capsid_protein__Norovirus__ACF41182
augaagauggccagcaacgacgcuucccccucugauggcagcaccgccaaucuggugccugaggucaacaaugaaguuauggcgcucgagccgguggugggggcugccaucgccgcucccgucacaggacagcaaaacgugauugacccuuggaucagaaauaacuucguucaggcccccggcggggaauuuacgguguccccucggaaugcucccggagagauucuguggucugccccucuuggcccggaucugaaccccuaccucagccaccuggcgcgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacgguggaaucccgcaccaaaccuuucacaguucccauccugaccguggaggaaaugacaaauagcagauuuccuauuccccuugagaagcuguucaccgggccgucuuccgcuuucgucgugcagccucagaacggacgguguacgacagauggcguucuccuggggaccacacaacugagccccgugaauaucugcaccuuucgcggagacgucacccauaucccuggcacaagaacguaccggaugaaccucgccucucagaauuggaacaauuaugaucccaccgaggaaauuccugcuccccugggcacaccggacuucguggggaaaauccagggaaugcuuacccagacaaccaagggcgacggguccacgcgcggacacaaggccacagucagcaccggcuccguggauuuuaccccuaaacuggggucuguucaauucgcgacagacaccgauaacgacuuugagacaggacagaauacgagauucacccccgugggcgucauucaggauggcagcuccacacaucggaacgaaccccaacagugggugcucccugacuacagcgggcgcaccgcccacaauguucaccuggcuccggccguggcccccacauuuccuggagagcagcuucuguucuuuagaucuaccaugcccggcuguuccggguacccuaacauggaucucgacugccugcugccccaggaauggguccaacauuucuaucaggaggcugccccuagccagucugauguggcgcuccugcgguuugugaaucccgacacgggaagaguucuuuucgaguguaagcugcacaaagcuggcuacgucaccguggcccauacagggcagcacgaucucgugaucccgccuaacggcuauuuucgcuucgacagcugggucaaucaauucuacacccuggcccccaugggaaacggcgcugggcggagacgcgcccuuuga

SEQ ID NO: 28098 - RNA, 1623 nt, Artificial Sequence
  derived and/or modified sequence opt5 from capsid_protein__Norovirus__ACF41183
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagagccuaccggaugaaccucgcuucucagaauuggaacaauuaugaucccacagaggaaauuccugcgccccugggcacgccggacuucguggggaaaauccagggaaugcuuacccagacaaccaagggcgacggguccacacgcggacacaaggccaccgucagcacgggcuccguggauuuuacaccuaaacuggggucuguucaauucgcuaccgacaccgauaacgacuuugagacaggacagaauaccagauucacacccgugggcgucauucaggauggcagcuccacgcaucggaacgaaccccaacagugggugcucccugacuacagcgggcgcaccguucacaaugugcaccuggccccggccgucgcucccacauuuccuggagagcagcuucuguucuuuagaucuaccaugcccggcuguuccggguacccuaacauggaucucgacugccugcugccccaggaaugggugcaacauuucuaucaggaggccgcgccuagccagucugauguggcucuccugcgguuuguuaaucccgacacaggaagaguccuuuucgaguguaagcugcacaaagccggcuacgugaccguggcccauacggggcagcacgaucucgucaucccgccuaacggcuauuuucgcuucgacagcugggugaaucaauucuacacccuggcucccaugggaaacggcgccgggcggagacgcgcucuuuga

SEQ ID NO: 28099 - RNA, 1623 nt, Artificial Sequence
  derived and/or modified sequence opt5 from capsid_protein__Norovirus__ACF41184
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccuggccguggaagagaugaccaacuccagauuuccuauuccccuugagaagcuguucacagggccgagcucugcucucgucgugcagccucagaauggacgguguaccacagacggcguucugcuggggaccacgcaacucucccccgugaacaucugcacauuccgcggagaugucacccauaucgcgggcagcagaaauuacacaaugaaccuggccucucuuaauuggaacaauuaugacccuaccgaagagauucccgcuccucugggcacccccgauuuuguggggaaaauccagggaguccucacacagacgaccaagggcgacggguccacacggggacacaaggccaccguguacacaggcagcgccccguucaccccuaaacugggguccguucaguuuggaacggacacagaaaacgauuucgagacccaucaaaauaccaaguuuacacccgugggcgucauucaggacggcucuaccacacaccgcaacgaaccccagcaaugggugcuuccuagcuacuccgggagaaauguucacaacgugcaucuggcuccggccgucgcgcccacguucccuggagagcagcuccuguuuuuccggagcaccaugcccggcuguucuggguauccuaauauggaucuggacugccuccugccccaggagugggugcagcacuuuuaccaagaagcugccccugcccaguccgauguggcccuucugcgcuucguuaaccccgacacaggaagaguccucuuugaguguaaacugcauaagagcggcuaugugaccguggcucacacagggcagcacgaucuugucaucccgccuaacggcuacuuccgguuugacucuugggugaaucaguucuauacccuggcucccaugggaaacggcacggggagacgccgggcccucuga

SEQ ID NO: 28100 - RNA, 1623 nt, Artificial Sequence
  derived and/or modified sequence opt5 from capsid_protein__Norovirus__ACF41185
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcggagccuucgucgugcagccucagaauggccgguguacaaccgaugggguucuccugggaacgacacaacugucucccgugaacaucugcaccuuucgcggcgacgucacacauaucgcuggcuccagagauuacaccaugaaucucgcgagccugaacuggaauaacuaugacccuaccgaggaaauucccgccccucuugggacacccgacuucgugggaaaaauccagggcguccugacgcagaccacaaagggggauggaucuacccggggccacaaggcuacaguguacaccggguccgccccguuuacgccuaaacucggaagcguucaguuccgcacagacaccgagaaugauuuugaaacccaucaaaacacaaaguucacccccgugggcgucauucaggacggcuccacaacgcacagaaaugagccccagcaaugggugcugccuucuuacagcgggcggaacguucacaaugugcaucuugccccggcugucgcccccaccuuuccuggagaacagcuccuguucuuucgcuccacaaugcccggcuguagcggguauccuaacauggaucuggacugccugcucccccaggagugggugcagcacuucuaccaagaggcggcuccugcccagucugauguggcccugcuuagauuuguuaaucccgacaccggacggguccuguucgaauguaaacuccauaaguccggcuaugugacaguggcucacaccgggcagcacgaucuggucaucccgccuaacggcuacuuuagauucgacagcugggugaaccaguucuauacgcuugcccccaugggaaauggcaccgggcgccggagagcucuguga

SEQ ID NO: 28101 - RNA, 1623 nt, Artificial Sequence
  derived and/or modified sequence opt5 from capsid_protein__Norovirus__ACF41186
augaagauggccagcaacgacgcuaaucccuccggcgggucugccgcgaaccuggugccugaggucaauaacgaaguuauggcucucgagccgguggugggagccgccaucgcugcccccgucgcuggccagcaaaaugugauugauccuuggaucagaaacaauuucguucaggcccccgggggagaauuuaccgugagcccucggaacgcgcccggcgagauucugugguccgccccucuugggccggaccugaaucccuaccucucucaccuggcucgcauguauaacggauacgccggcggcuucgaaguccaggugauccuugcugggaaugccuuuacagcgggaaaaauuaucuucgccgcuguuccucccaacuuuccuacggagggccugagccccucccaggugaccauguucccgcauaucauugucgaugugagacaacucgagccugugcugaucccccugccugacguccggaauaacuuuuaucacuacaaucagucuaacgauagcacaauuaagcucaucgccaugcuguauacaccccuucgcgcuaacaaugccggggaagacguuuucaccguguccugcagagugcugacccggcccagcccugauuuugacuucauuuuucucgucccgcccacaguggagucucgcaccaaaccuuucacgguucccauccugaccguggaagagaugacaaacuccagauuuccuauuccccuugagaagcuguucaccggaccgagcucugccuucgucgugcagccucagaauggccgguguacaaccgaugggguucuccugggaacgacacaacugucccccgugaacaucugcaccuuucgcggcgacgucacacauaucgcuggcagcagaaauuacaccaugaaccucgcgucucugaauuggaacaauuaugauccuaccgaagagauucccgccccucuugggacacccgacuucgugggaaaaauccagggcguccugacgcagaccacaaagggggauggauccacccggggccacaaggcuacaguguacaccgggagcgccccguuuacgccuaaacucggauccguucaguucucuacagacaccgaaaacgacuuugagacccaucaagauacaaaguucacccccgugggcgucauucaggacggcgggacaacgcaccgcaaugaaccccagcaaugggugcugccuagcuacuccggaagaaacguucagaaugugcaccuugccccggcugucgcccccaccuuuccuggcgagcagcuccuguucuuucggagcacaaugcccggguguucuggauauccuaacauggaucuggacugccugcucccccaggagugggugcaacauuucuaccaggaagcggcuccugcccaguccgauguggcccugcuucgcuuuguuaaucccgacaccggcagaguccuguucgaguguaaacuccacaagagcggguaugugacaguggcucauaccggccagcacgaucuggucaucccgccuaacggauacuuucgguucgacucuugggugaaccaauucuauacgcuugcccccaugggcaaugggaccggaagacgccgggcucuguga

SEQ ID NO: 28102 - RNA, 1623 nt, Artificial Sequence
  derived and/or modified sequence opt5 from capsid_protein__Norovirus__ACF41187
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccggggaguccugacgcagaccacaaagggcgacggguccacccgcggacacaaggcuacaguguacaccggcagcgccccguuuacgccuaaacucggguccguucaguucucuacagacaccgaaaacgauuuugagacccaucagaauacaaaguucacccccgugggagucauucaagacggcggcacaacgcacagaaacgaaccccagcagugggugcugccuagcuacuccgggcggaauguuccgaacgugcaccuugcccccgcugucgccccuaccuuucccggagagcaacuccuguucuuucgcagcacaaugccuggcuguucuggguaucccaauauggaucuggacugccugcucccucaggagugggugcagcauuucuaccaggaagcggcucccgcccaauccgauguggcccugcuuagauuuguuaacccggacaccggacggguccuguucgaguguaaacuccacaagagcggcuaugugacaguggcucauaccgggcagcacgaucuggucaucccucccaacggcuacuuuagauucgacucuugggugaaucaguucuauacgcuugccccuaugggaaacggcaccgggcgccggagagcucuguga

SEQ ID NO: 28103 - RNA, 1623 nt, Artificial Sequence
  derived and/or modified sequence opt5 from capsid_protein__Norovirus__ACF41188
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacagccuacaccggcagcgccccguuuacgccuaaacucggguccgugcaguucucuacagacaccgaaaacgauuuugagacccaucaaaauacaaaguucgcucccguuggagugauucaggacggcggcaccacacaccgcaacgaaccccagcaauggguccugccuagcuacuccgggagaaaugugccgaacguucaccuugcccccgcgguggcuccuacguuucccggagagcagcuccuguucuuucggagcaccaugccuggcuguucuggguaucccaauauggaucuggacugccugcucccucaggaguggguccagcauuucuaccaagaagccgcccccgcucaguccgauguggcccugcuucgcuuugugaacccggacacaggaagaguucuguucgaguguaaacuccacaagagcggcuaugucaccguggcucauacagggcagcacgaucuggugaucccucccaacggcuacuuucgguucgacucuugggucaaucaguucuauacccuugccccuaugggaaacggcacggggagacgccgggcgcuguga

SEQ ID NO: 28104 - RNA, 1623 nt, Artificial Sequence; identical to SEQ ID NO: 27081
  derived and/or modified sequence opt5 from capsid_protein__Norovirus__ACF41190

SEQ ID NO: 28105 - RNA, 1623 nt, Artificial Sequence
  derived and/or modified sequence opt5 from capsid_protein__Norovirus__ACF41191
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccuggguuugacuucauuuuucucgucccgcccacaguggagucucgcaccaaaccuuucacgguucccauccugaccguggaagagaugacaaacuccagauuuccuauuccccuugagaagcuguucaccggaccgagcucugccuucgucgugcagccucagaauggccgguguacaaccgaugggguucuccugggaacgacacaacugucccccgugaacaucugcaccuuucgcggcgacgucacacauaucgcuggcagcagaaauuacaccaugaaccucgcgucucugaauuggaacaauuaugauccuaccgaagagauucccgccccucuugggacacccgacuucgugggaaaaauccagggcguccugacgcagaccacaaagggggauggauccacccggggccacaaggcuacaguguacaccgggagcgccccguuuacgccuaaacucggauccguucaguucucuacagacaccgaaaacgacuuugagacccaucaaaauacaaaguucacccccgugggcgucauucaggauggcgggacaacgcaccgcaacgaaccccagcaaugggugcugccuagcuacuccggaagaaauguuccgaacgugcaccuugcccccgcugucgccccuaccuuucccggcgagcagcuccuguucuuucggagcacaaugccuggguguucuggauaucccaauauggaccuggauugccugcucccucaggagugggugcagcauuucuaccaagaagcggcucccgcccaguccgacguggcccugcuucgcuuuguuaacccggauaccggcagaguccuguucgaguguaaacuccacaagagcggguaugugacaguggcucauaccggccagcacgaccuggucaucccucccaacggauacuuucgguucgauucuugggugaaucaguucuauacgcuugccccuaugggcaacgggaccggaagacgccgggcucuguga

SEQ ID NO: 28106 - RNA, 1647 nt, Artificial Sequence
  derived and/or modified sequence opt5 from capsid_protein__Norovirus__ACF60293
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgagaaucuguccgccgcucagauuacaaugugcccucaugugaucgucgacgugcgccaacuggaacccguuaaccucccgaugccugaugugagaaauaacuucuuucacuauaaccagggcucugacagcaagcugcggcuugucgccaugcuguacacaccccuccgcgccaauaacuccggggaugacguguucaccgugucuuguagaguccugacccggccuagccccgauuuuuccuucaauuuucuuguucccccuacaguggagagcaaaaccaagccguucacgcugcccauucucaccaucucugaaauguccaacagccgcuuuccugugcccauugacucucugcauacauccccuaccgagaauaucgucgugcagugccagaacggaagaguuacacuggauggcgagcucauggggaccacgcaacugcuucccagccagaucugugcuuuccggggagugcugacacgcucuaccuccagagcgagcgaccaggccgauacagcuaccccgcggcuuuucaauuauuacuggcacauucagcuggacaaccuuaauggcaccccuuaugaccccgccgaagauaucccuggcccccuggggacaccugacuuucgcggaaaagucuucggcguggccucccaaagaaaccccgauucuacgacccgggcucaugaggccaagguugacacaaccgcggggcgcuuuacaccgaagcucggaagccuggaaauuuccaccgagagcggcgauuucgaccagaaucagccuacgagauuuacacccguggggaucggagucgaucacgaagcugacuuccaacaguggucucugcccgauuacuccggccaguuuacccacaacaugaaucucgccccugccguggcuccgaacuuccccggcgagcagcugcucuuuuuccggagccaacugccuucuagcgggggaagauccaauggcauucucgacugccgcgucccccaggagugggugcagcauuuuuaccaggaaucugccccugcucaaacccagguugcccuggugcgguaugucaaccccgauacagggagagugcuuuucgaggcgaaacugcacaagcucggauuuaugaccaucgccaaaaacggcgacagcccuaucacaguucccccgaauggguacuuccgcuucgaauccugggugaacccuuuuuauacgcuggcucccaugggcaccggaaauggccggagacgcauucaguga

SEQ ID NO: 28107 - RNA, 1647 nt, Artificial Sequence
  derived and/or modified sequence opt5 from capsid_protein__Norovirus__ACF60294
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgacuuuuccuucaauuuucuuguucccccuacaguggaaagcaagaccaaaccguucacgcugcccauucucaccaucucugagauguccaacagcagauuuccugugcccauugauucucugcauacauccccuaccgaaaauaucgucgugcagugccagaacggacggguuacacuggacggcgagcucauggggaccacgcaacugcuucccagccagaucugugcuuuccgcggagugcugacaagaucuaccucccgggcgagcgaucaggccgacacagcuaccccgcgccucuucaauuauuacuggcacauucagcuggacaaccuuaauggcaccccuuaugaucccgccgaggacaucccuggcccccuggggacaccugauuuuagaggaaaggucuucggcguggccucccaacggaaccccgacucuacgacccgcgcucaugaagccaaaguugauacaaccgcggggagauuuacaccgaagcucggaagccuggagauuuccaccgaaagcggcgacuucgaucagaaucagccuacgcgguuuacacccguggggaucggagucgaccacgaggcugauuuccaacaguggucucugcccgacuacuccggccaguuuacccacaacaugaaucucgccccugccguggcuccgaacuuccccggcgaacagcugcuguuuuucagaagccaacuuccuucuagcgggggacgcuccaauggcauucucgauugccuggucccccaggagugggugcagcauuuuuaccaggagucugccccugcucaaacccagguugcccuugugcgguaugucaaccccgacacagggagagugcuguucgaagcgaagcuccacaaacugggauuuaugaccaucgccaagaacggcgacagcccuaucacaguucccccgaauggguacuuccgcuucgaguccugggugaacccuuuuuauacgcuggcucccaugggcaccggaaauggccggagacgcauucaguga

SEQ ID NO: 28108 - RNA, 1647 nt, Artificial Sequence
  derived and/or modified sequence opt5 from capsid_protein__Norovirus__ACF60295
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugccucuuaaccuggagcucgggccggaaauuaaucccuaccuggcccaccuugcucggauguauaacggauacgccggcggcuucgagguccaggugguucuggcugggaaugccuuuaccgcgggaaaaaucaucuucgccgcuauuccucccaacuuuccuacagacaaucucuccgccgcucagaucaccaugugcccccaugugauugucgaugugcgccaacuggagccgguuaaccugccuaugcccgacgugagaaauaacuucuuucacuauaaccagggcucugauagccggcuccgccuggucgccaugcuuuacacaccucugagagccaauaacuccggggacgauguguucaccgugucuugucggguccucacacgccccagccccgacuuuuccuucaauuuucugguuccuccgaccguggaaagcaagacgaaacccuucacccuuccuauccugacaauuucugagauguccaacagcagauuucccgugccuaucgauucucuccauaccucccccacagaaaauauugucgugcagugccagaacggacggguuacccuggacggcgagcugauggggacgacacaacuccugccgagccagaucugugcuuuccgcggagugcuuaccagaucuacaucccgggcgagcgaucaggccgacaccgcuaccccucgccuguucaauuauuacuggcacauccagcucgacaaccugaauggcacacccuaugauccugccgaggacauucccggcccucuugggacgcccgauuuuagaggaaaggucuucggcguggccucccaacggaacccggacucuaccacacgcgcucaugaagccaaaguugauaccacagcggggagauuuaccccuaagcugggaagccucgagaucuccacggaaagcgacgauuucgaccagaaucagcccacacgguuuacccccgugggcauuggggucgaucacgaggcugacuuccaacaguggucucugccugauuacuccggacaguuuacccacaacaugaaucuggccccggccguggcucccaacuucccuggcgaacagcuccuguuuuucagaagccaacuucccucuagcggcgggcgcuccaauggaauccuggacugccucgucccucaggagugggugcagcauuuuuaccaggagucugcccccgcucaaacacagguugcccuggugcgguaugucaacccugacaccggcagagugcuuuucgaagcgaagcugcacaaacucggguuuaugacaauugccaagaacggagauagccccaucacgguuccgccuaauggcuacuuccgcuucgaguccugggugaaccccuuuuauacccuggcuccuauggggacaggcaauggacggagacgcauccaguga

SEQ ID NO: 28109 - RNA, 1647 nt, Artificial Sequence
  derived and/or modified sequence opt5 from capsid_protein__Norovirus__ACF60296
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgacuuuuccuucaauuuucuuguucccccuacaguggaaagcaagaccaaaccguucacgcugcccauucucaccaucucugagauguccaacagcagauuuccugugcccauugauucucugcauacauccccuaccgaaaauaucgucgugcagugccagaacggacggguuacacuggacggcgagcucauggggaccacgcaacugcuucccagccagaucugugcuuuccgcggagugcugacaagaucuaccucccgggcgagcgaucaggccgacacagcuaccccgcgccucuucaauuauuacuggcacauucagcuggacaaccuuaauggcaccccuuaugaucccgccgaggacaucccuggcccccuggggacaccugauuuuagaggaaaggucuucggcguggccucccaacggaaccccgacucuacgacccgcgcucaugaagccaaaguugauacaaccgcggggagauuuacaccgaagcucggaagccuggagauuuccaccgaaagcgacgauuucgaccagaaucagccuacgcgguuuacacccgugggcaucggggucgaucacgaggcugacuuccaacaguggucucugcccgauuacuccggacaguuuacccacaacaugaaucucgccccugccguggcuccgaacuuccccggcgaacagcugcuguuuuucagaagccaacuuccuucuagcggcgggcgcuccaauggcauucucgacugccuggucccccaggagugggugcagcauuuuuaccaggagucugccccugcucaaacccagguugcccuugugcgguaugucaaccccgacacaggaagagugcuguucgaagcgaagcuccacaaacugggguuuaugaccaucgccaagaacggagauagcccuaucacaguucccccgaauggcuacuuccgcuucgaguccugggugaacccuuuuuauacgcuggcucccauggggaccggcaauggacggagacgcauucaguga

SEQ ID NO: 28110 - RNA, 1647 nt, Artificial Sequence
  derived and/or modified sequence opt5 from capsid_protein__Norovirus__ACF60297
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgacuuuuccuucaauuuucuuguucccccuacaguggaaagcaagaccaaaccguucacgcugcccauucucaccaucucugagauguccaacagcagauuuccugugcccauugauucucuguauacauccccuaccgaaaauaucgucgugcagugccagaacggacggguuacacuggacggcgagcucguggggaccacgcaacugcuucccagccagaucugugcuuuccgcggaguccugacaagaucuaccucccgggcgagcgaucaggccgacacagcuaccccgcgccucuucaauuacuauuggcauauucagcuggacaaccuuaauggcaccccuuacgaucccgccgaggacaucccuggcccccuggggacaccugauuuuagaggaaagguguucggcguugccucccaacggaaccccgacucuacgacccgcgcucacgaagccaaaguggauacaaccgcggggagauuuacaccgaagcucggaagccuggagauuuccaccgaaagcggcgacuucgaucagaaucagccuacgcgguuuacacccgucgggaucggaguggaccaugaggcugauuuccaacaguggucucugcccgacuacuccggccaguuuacccacaacaugaaucucgccccugccgucgcuccgaacuuccccggcgaacagcugcuguuuuucagaagccaacuuccuucuagcgggggacgcuccaauggcauucucgauugccuggugccccaggaguggguucagcacuuuuaucaggagucugccccugcucaaacccagguggcccuuguccgguacgugaaccccgacacagggagaguucuguucgaagcgaagcuccauaaacugggauuuaugaccaucgccaagaacggcgacagcccuaucacagugcccccgaauggguauuuccgcuucgaguccugggucaacccuuuuuacacgcuggcucccaugggcaccggaaauggccggagacgcauucaguga

SEQ ID NO: 28111 - RNA, 1626 nt, Artificial Sequence
  derived and/or modified sequence opt5 from capsid_protein__Norovirus__ACF72688
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucucuccccggaauacaccuggcgaaauucuuuuugaucuggcucucgggccgggacugaaccccuaccuugcccaccuguccgcuauguauacgggcugggucggcaauauggaggugcagcucguucuggccgggaacgcguucaccgccggaaaaguggucguggcucugguuccucccuacuuuagcaagggcucccucacaaccgcccagaucacauguuucccucaugugaugugcgacguccgcacccuggaacccauccaacuuccgcugcucgaugugagacgggugcuguggcacgcuacacaggaccaggaggagucuaugcgccuugucuguaugcuguauaccccucucagaacgaauagccccggggaugaauccuuuguugugagcggacggcugcugucuaaaccugcccccgacuucaacuuuguguaccucacacccccuauugagcgcaccaucuauagaauggucgaucugccgcuucugcagccccggcucugcacccaugcccgcuggccugcucccguguacggccugcuuguugacccuucccugcccagcaauccgcaauggcagaacgggagagugcacgucgauggaacacuccugggcaccacgccugugucuggcuccuggguuagcuguuucgcggccgaagcugccuaugaguuucagucugggauuggagagguggucacauucaccaugaucgaacaagacggcuccgccuacgugcccggggaucgggcugccccucugggauaccccgacuuuagcggccagcucgagauugaaguccagacagagaccaccaagacaggggacaaacugaaggugacgaccuucgaaaugauccuuggaccuacaaccaauguugaucaggcgcccuaucaaggccgcgcuuacgccucccugacagccauggcuucucucgaccugguggauggcagaguccgggccgugccgcgcagcauuuauuccuuccaggacgagcuuccugaguacaacgaugggcugcucguuccccuggcucccccucugggaccguuucuccccggcgaagugcugcuuagauuccggaccuauaugagacagcuggacacggccgaugcggccgcucagccuaucgacugcgcccucccccaagaguuuaucagcugguucgcuucuaauaacuuuacaguccaguccgaugcccugcuggugcgcuaccggaauacccuuaccgggcagcuccuguucgaagcgaagcuguauagcgagggauacauugccgugucuuacagcggcuccgggccucucacauuucccaccgacggcuucuuugaaguugucucuugggugccuagacuguuccagcuugcuagcgugggaucccuggccacaggccgcacgcucaaacaauga

SEQ ID NO: 28112 - RNA, 1623 nt, Artificial Sequence
  derived and/or modified sequence opt5 from capsid_protein__Norovirus__ACH42093
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaaaauucacgcccgucggagugguucaagauggcuccaccacacaccagaaugaaccccagcagugggugcucccugacuacagcggcagagauucucacaacguccaucuggcuccggccguggcccccaccuuuccuggggagcaacuucuguucuuucgguccacaaugcccggauguagcggcuacccuaauaugaaccucgacugccugcugccccaggaaugggugcagcacuucuaucaggagucugcuccugcccaaagcgauguugcgcuccugcgcuuugucaaucccgacaccgggagagugcuuuucgaguguaagcugcauaaauccggauacgugacggucgcucacaccggccagcacgaucucgugauuccgccuaacggguauuuucgguucgacucuuggguuaaccaguucuacacacuggcccccaugggcaauggagccggcagacgccgggcucuuuga

SEQ ID NO: 28113 - RNA, 1623 nt, Artificial Sequence; identical to SEQ ID NO: 26947
  derived and/or modified sequence opt5 from capsid_protein__Norovirus__ACH42094

SEQ ID NO: 28114 - RNA, 1623 nt, Artificial Sequence; identical to SEQ ID NO: 26947
  derived and/or modified sequence opt5 from capsid_protein__Norovirus__ACH42096

SEQ ID NO: 28115 - RNA, 1623 nt, Artificial Sequence; identical to SEQ ID NO: 26947
  derived and/or modified sequence opt5 from capsid_protein__Norovirus__ACH42097

SEQ ID NO: 28116 - RNA, 1623 nt, Artificial Sequence; identical to SEQ ID NO: 26947
  derived and/or modified sequence opt5 from capsid_protein__Norovirus__ACH42098

SEQ ID NO: 28117 - RNA, 1623 nt, Artificial Sequence
  derived and/or modified sequence opt5 from capsid_protein__Norovirus__ACJ66263
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacgucgcccugcuuagauuugugaacccugauaccggacgcgugcuguucgaguguaaacuccacaaguccggcuacguuacagucgcucauaccgggcagcacgaccuggugauucccccgaacggcuauuuucgguucgauagcugggugaaucaauuuuacacgcuugccccuaugggaaacggcgcggggagacgccgggcccuguga

SEQ ID NO: 28118 - RNA, 1623 nt, Artificial Sequence
  derived and/or modified sequence opt5 from capsid_protein__Norovirus__ACJ66265
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaaugagcccgcauaucauugucgacgugagacaacucgagccugugcugaucccccugccugauguccggaacaauuucuaucacuacaaccaguccaaugaccccaccauuaagcucaucgcuaugcuguauacaccccuucgcgccaacaacgcuggcgaugacguuuuuaccgugagcugcagagugcugacacggccuucuccggauuucgacuuuauuuuccucgugcccccuaccgucgaaucccgcacgaaacccuuuagcguuccuauccugaccguggaggaaaugacaaauucuagauuccccauuccgcuugagcggcuguuuaccgggccuuccagcgccuucgucgugcagccccagaacggacgcuguacaaccgauggcguucuccuggggacgacacaacugucuccugugaauaucugcaccuucagaggagacgucacacauaucgccggcacccaggaguacaccaugaaccucgcuucccagaauuggaacaauuaugaucccacagaagagauuccugcgccccugggcacgccggacuuuguggggaagauccagggaguccuuacccaaacaacccggcgcgacggcagcacaagagggcacaaagccaccguguccacgggaucuguucauuucacaccuaagcugggccggauucaguuuagcaccgauaccuccaacgacuucgaaacagggcagaauacccgcuuuacacccgugggagucgugcaagauggcggcacgacccaccagaacgagccccagcaguggguucucccuaauuacagcgggagagacggacacaacgugcaucuggcuccggccgucgcccccucuuucccuggcgaacaacuucuguuuuuccgguccacaaugcccggguguagcggauacccuaauaugaaccucgauugccugcugccccaggagugggugcagcacuuuuaucaggaggcugccccugcgcaaucugacguggcucuccugagauucguuaaucccgauaccggccgcguccuuuuugaauguaagcugcauaaaagcggguacgugacaguggcccacaccggccagcacgaccucgucaucccgccuaacggauauuuccgguuugauuccugggugaaccaguucuacacgcuggcccccaugggcaaugggaccggaagacgccgggcucuuuga

SEQ ID NO: 28119 - RNA, 1623 nt, Artificial Sequence
  derived and/or modified sequence opt5 from capsid_protein__Norovirus__ACJ66267
augaagauggccagcaacgacgcuaaucccuccgauggcucuaccgccaaccuggugccugaggucaauagcgaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucaccguuccuauccugacaguggaggaaaugaccaauuccagauuucccauuccgcuugagcggcuguacacagggccuagcucugccuucgucgugcagccccagaacggacgcuguaccacggauggcguucuccuggggacaacccaacuguccgccgugaauaucugcacauucagaggagacgucacccauaucgcuggcagccggaacuauaccaugaaucucgcgucucagaacuggaauaacuacgauccuacagaggaaauucccgccccucugggcacgcccgacuuuguggggaagauccagggaaugcuuacccagacaacccgcuccgacggcagcacaagagggcacaaagcuaccguccugacgggauccgccgauuucgccccgaagcucggccgggugcaauuugcuacagacaccgauaaugacuucgagucugggcagaacaccaaguuuacaccuguuggagugauucaggauggcagcaccacacaucgcaaugaaccccaacaguggguccugcccuccuacagcggcagaacggggcacaacgugcaccuugccccugcgguugcuccgaccuaucccggagagcagcuccuguucuuucggucuacaaugccuggcuguuccggguaccccaauauggaccuggauugccugcucccucaggaaugggugcaacauuucuaucaggaggccgcccccgcucagagcgacgucgcccugcuuagauuugugaacccugauaccggacgcgugcuguucgaguguaaacuccacaagucuggcuacguuacagucgcucauaccgggcagcacgaccuggugauucccccgaauggcuauuuucgguucgauagcugggugaaccaauuuuacacgcuugccccuaugggaaacggcgcggggagacgccgggcccuguga

SEQ ID NO: 28120 - RNA, 1623 nt, Artificial Sequence
  derived and/or modified sequence opt5 from capsid_protein__Norovirus__ACJ66269
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugccaauaucugcaccuuuagaggagacgugacacauaucgcuggcacccaggaguacaccaugaaccucgcgucucagaauuggaacaauuaugaucccacagaagagauuccugcuccccugggcacgccggacuucgucgggaagauccagggagugcuuacccaaacaacccggcgcgacggcuccacaagagggcacaaagccaccgucagcacgggauccgugcauuuuacaccuaagcugggccggauucaguucucuaccgauaccagcaacgacuuugaaacagggcagaauacccgcuucacacccguuggagugguccaagauggcggcacgacccaccagaacgagccccagcagugggugcucccuaauuacuccgggagagacggacacaacguucaucuggccccggccguggcucccagcuuuccuggcgaacaacuucuguucuuucggucuacaaugcccggguguuccggauacccuaauaugaaccucgauugccugcugccccaggaguggguccagcacuucuaucaggaggccgcgccugcucaaagcgacguggcccuccugagauuugugaaucccgauaccggccgcguucuuuucgaauguaagcugcauaaaucuggguacgucacaguggcccacaccggccagcacgaccucgugaucccgccuaacggauauuuucgguucgauagcugggucaaccaguucuacacgcuggcucccaugggcaaugggaccggaagacgccgggcccuuuga

SEQ ID NO: 28121 - RNA, 1623 nt, Artificial Sequence
  derived and/or modified sequence opt5 from capsid_protein__Norovirus__ACJ66271
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcucugugaauaucugcaccuuuagaggagacgucacacauaucgccggcacccaggaguacaccaugaaccucgcuucccagaauuggaacaauuaugauccuacagaagagauucccgcgccucugggcacgcccgacuucguggggaagauccagggaguccuuacccaaacaacccggcgcgacggcagcacaagagggcacaaagccaccguguccacgggaucuguucauuuuacaccgaagcugggccggauucaguucagcaccgauaccuccaacgacuuugaaacagggcagaauacccgcuucacaccugugggagucgugcaagauggcagcacgacccaccagaacgagccccagcaguggguucuccccaauuacucuggcagagacgggcacaacgugcaucuggcuccugccgucgccccguccuuucccggagaacaacuucuguucuuucggagcacaaugccuggcuguucuggguaccccaauaugaaccucgauugccugcugccucaggagugggugcagcacuucuaucaggaggcugcccccgcgcaaagcgacguggcucuccugagauuuguuaauccugauaccggacgcguccuuuucgaauguaagcugcauaaauccggcuacgugacaguggcccacaccgggcagcacgaccucgucauucccccgaacggcuauuuucgguucgauucuugggugaaccaguucuacacgcuggccccuaugggaaauggcaccgggagacgccgggcucuuuga

SEQ ID NO: 28122 - RNA, 1623 nt, Artificial Sequence
  derived and/or modified sequence opt5 from capsid_protein__Norovirus__ACJ66273
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaagcacgacccaccagaacgagccccagcaguggguucucccuucuuacuccggccgcgacagccacaaugugcaucuggcuccggccgucgcccccucuuuuccuggcgaacaacuucuguucuuuagaagcacaaugcccggguguuccggauacccuaacaugaaucucgauugccugcugccccaggagugggugcagcacuucuaucaggaggcugccccugcgcaaucugacguggcucuccugcgguuuguuaaccccgauaccggcagaguccuuuucgaauguaaacugcauaagagcggguacgugacaguggcccacaccggacagcacgaccucgucaucccgccuaauggcuauuuucgcuucgauuccugggugaaccaguucuacacgcuggcccccauggggaacggcgcuggacggagacgcgcccuuuga

SEQ ID NO: 28123 - RNA, 1623 nt, Artificial Sequence
  derived and/or modified sequence opt5 from capsid_protein__Norovirus__ACJ66275
augaagauggccagcuccgacgcuucucccagcgauggcuccgccgcgaaccuggugccugaggucaauaacgaaguuauggcucucgagccgguggugggggccgccaucgcugcccccgucgcuggacagcaaaauaucaucgacccuuggauuagaaacaauuucgugcaggcccccggcggggaauuuaccguuucuccucggaacgcgcccggagagauccuguggagcgccccucuuggcccggaucugaaucccuaccucucccaccugucucgcauguauaacggguacgcuggaggcuucgaagugcaggucauucuugccggcaaugcuuuuacagccgggaaagugaucuucgcggccguuccucccaacuuuccuacggagggacugagccccucccaggugaccauguucccgcauaucauugucgacgugagacaacucgagccugugcugaucccccugccugauguccggaauaacuuuuaucacuacaaucagacaaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucaccguuccuauccugacaguggaggaaaugaccaacagcagauuucccauuccgcuugagcggcuguacacagggccuucuuccgccuucgucgugcagccccagaauggacgcuguaccacggauggcguucuccuggggacaacccaacugagcgccgugaacaucugcacauucagaggagacgucacccauaucgcuggcucucggaauuauaccaugaaccucgcgucccagaauuggaacaauuacgauccuacagaggaaauucccgccccucugggcacgcccgacuuuguggggaagauccagggaaugcuuacccagacaacccgcggcgacgggagcacaagaggacacaaagcuaccgucuacacgggcuccgccgauuucgccccgaagcuggggcgggugcaauuugcuacagacaccgauaacgacuucgagucuaaucagaacaccaaguuuacaccuguuggagugauucaggauggcaauaccacacaucgcaacgaaccccaacaguggguccuccccggcuauagcgggagagacggacacaaugugcaccuggccccugcgguugcuccgacguaccccggcgagcagcuucuguucuuucgguccaccaugccuggguguagcggauaucccaacauggaucucgacugccugcugccucaggaaugggugcaacauuucuaccaggaggccgcccccgcucagucugaggucgcccuccugagauuugugaauccugauacaggccgcgugcuuuucgaauguaaacugcacaaguccggguauguuaccgucgcucauacaggccagcacgaccucgugauucccccgaacggauacuuucgguucgauagcugggugaaccaauuuuauacccuggccccuaugggcaauggggcgggaagacgccgggcccuuuga

SEQ ID NO: 28124 - RNA, 1623 nt, Artificial Sequence
  derived and/or modified sequence opt5 from capsid_protein__Norovirus__ACJ66279
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaauuuuccuggggagcaacuucuguucuuucgcuccaccaugcccggauguagcggcuacccuaacaugaaucucgacugccugcugccccaggaaugggugcagcacuucuaucaggagucugcuccugcccaaagcgauguugcgcuccugagauuugucaaccccgacacagggcgggugcuuuucgaguguaaacugcauaaguccggauacgugaccgucgcucacacgggccagcacgaucucgugauuccgccuaacggguauuuuagauucgacucuuggguuaaucaguucuacacccuggcccccaugggcaacggagccggccgccggagagcucuuuga

SEQ ID NO: 28125 - RNA, 1623 nt, Artificial Sequence
  derived and/or modified sequence opt5 from capsid_protein__Norovirus__ACJ66281
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaaaagaugacaaauagcagauuuccuauuccccuugagaaacuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaggaaauucccgccccucuugggacacccgauuucgugggaaagauccagggcguccugacgcagaccacaaagggggacggauccacccggggccacaaagcuacaguguacaccgggagcgccccguuuacgccuaagcucggauccguucaguucucuacagacaccgagaaugauuuugaaacccaucaaaacacaaaauucacccccgugggcgucauucaggacggcagcacaacgcaccgcaaugagccccagcaaugggugcugccuuccuacagcgggagaaacguucacaaugugcaucuugccccggcugucgcccccaccuuuccuggagaacagcuccuguucuuucggucuacaaugcccggcuguuccggguauccuaacauggaucuggacugccugcucccccaggagugggugcagcacuucuaccaagaggcggcuccugcccagagcgauguggcccugcuucgcuuuguuaaucccgacaccggaagaguccuguucgaauguaagcuccauaaaucuggcuaugugacaguggcucacaccgggcagcacgaucuggucaucccgccuaacggcuacuuucgguucgacagcugggugaaccaguucuauacgcuugcccccaugggaaauggcaccgggagacgccgggcucuguga

SEQ ID NO: 28126 - RNA, 1623 nt, Artificial Sequence
  derived and/or modified sequence opt5 from capsid_protein__Norovirus__ACJ66283
augaagauggccagcaacgacgcuaaucccuccgauggcucugccgcgaaccuggugcucgaggucaauaacgaaguuauggcucuggagccuguggugggggccgccaucgcugccccggucgcuggacagcaaaaugugaucgaccccuggaucagaaacaauuucguucaggccccuggcggggaauuuaccgugagcccccggaacgcgccuggagagauucuuugguccgcuccccugggcccugaucucaauccguaccugucucaccuugcccgcauguauaacggguacgccggaggcuucgaaguccaggugauccuggcuggcaaugccuuuacagcggggaaaauuaucuucgccgcuguucccccuaacuuucccacggagggacucagcccuucccaggugaccauguucccccauaucauugucgacgugagacaacuggagccggugcugaucccucuccccgauguccggaauaacuuuuaucacuacaaucagucuaacgacagcacaauuaagcugaucgccaugcuuuauaccccucugcgcgcuaacaaugccggcgaagauguuuucacaguguccugcagagugcucacccggcccagccccgacuuugauuucauuuuucuggucccuccgacaguggagucucgcaccaaacccuucacgguuccuauccuuaccguggaagagaugacaaacuccagauuucccauuccucuggagaaacucuucaccgggcccagcggagccuucgucgugcagccgcagaauggccgguguacaaccgacgggguucugcugggaacgacacaacucucuccugugaacaucugcaccuuucgcggcgaugucacacauaucgcuggcuccagaaauuacaccaugaaccuggcgagccuuaauuggaacaauuaugaccccaccgaagagauuccugcuccccuggggacaccugauuucgugggaaagauccagggcguccucacgcagaccacaaagggggacggaucuacccggggccacaaggccacaguguacaccggguccgcccccuuuacgccgaaacugggaagcguucaguucuccacagacaccgaaaacgauuuugagacccaucaaaauacaaaguucaccccugugggcgucauucaggacggcucuacaacgcaccgcaacgaaccccagcaaugggugcuucccagcuacuccgggagaaauguucacaacgugcaucuggccccugcugucgccccgaccuuucccggagagcagcuccuguucuuucggagcacaaugccuggcuguucuggguaucccaauauggaucuggacugccuccugccucaggagugggugcagcacuucuaccaagaagcggcucccgcccaguccgauguggcccuucugcgcuuuguuaacccugacaccggaagaguccucuucgaguguaaacugcauaagagcggcuaugugacaguggcucacaccgggcagcacgaucuugucauucccccgaacggcuacuuucgguucgacucuugggugaaucaguucuauacgcuggccccuaugggaaacggcaccgggagacgccgggcucucuga

SEQ ID NO: 28127 - RNA, 1623 nt, Artificial Sequence
  derived and/or modified sequence opt5 from capsid_protein__Norovirus__ACJ66285
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuagaauccggaauaacuucguucaggcucccggcggggaauuuacaguguccccucgcaaugcccccggagagauucuguggucugcgccucuuggcccggaucugaaccccuaccucagccaccuggccagaauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugcggcaacucgagccugugcugaucccccugccugauguccgcaacaauuuuuaucacuacaaccaguccaaugaccccaccauuaagcucaucgcuaugcuguauacaccccuuagagccaacaacgcuggagaugacguuuucaccgugagcugcugggugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagaagcgacggauccacacggggccacaaggccaccgugucuacggggagcguucauuuuacaccuaagcugggacgcauucaguucuccaccgauaccagcaacgacuuugaaacaggccagaauaccagauucacacccgugggggucgugcaagauggaucuacgacccaccagaacgagccccagcaguggguucucccuaauuacuccggccgggacagccacaacgugcaucuggcuccggccgucgcccccucuuuuccuggcgaacaacuucuguucuuucgcagcacaaugcccggguguuccggauacccuaauaugaaccucgauugccugcugccccaggagugggugcagcacuucuaucaggaggcugccccugcgcaaucugacguggcucuccugagauuuguuaaucccgauaccggccggguccuuuucgaauguaaacugcauaagagcggguacgugacaguggcccacaccggacagcacgaccucgucaucccgccuaacggcuauuuuagauucgauuccugggugaaccaguucuacacgcuggcccccauggggaauggcaccggacgccggagagcucuuuga

SEQ ID NO: 28128 - RNA, 1623 nt, Artificial Sequence; identical to SEQ ID NO: 26932
  derived and/or modified sequence opt5 from capsid_protein__Norovirus__ACJ66286

SEQ ID NO: 28129 - RNA, 1626 nt, Artificial Sequence
  derived and/or modified sequence opt5 from capsid_protein__Norovirus__ACJ72216
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccauuuacggccuccugguugacccuucucuucccuccaauccgcaauggcagaacgggagagugcacgucgauggaacacugcucggcaccacgccuaucagcggcucuuggguguccuguuucgccgcugaagccgccuaugaguuucagagcgggacaggagagguugugaccuucucuaugauugaacaagacggcuccgcuuacguccccggggaucgggccgcgccucugggauaccccgacuauagcggccagcuggagaucgaagugcagacagagaccaccaaggcuggggacaaacucaaggucacaacguuugaaaugauucugggaccuaccacaaauguggaucaggcccccuaccaaggcaaggccuaugcuucccuuucuaccacagccagccuggaccucguugauggccgcgugagagcugucccgcgguccguguacagcuuccaggacguucugccugaguauaacgaugggcuucuggugccccucgcgcccccucugggaccguaccugcccggcgagguccuccugcgcuucagaaccuauaugcggcagcuugacacggccgaugccgcugcccagccuaucgacugcgcucugccccaagaauuuaucucuugguucgccuccagcaauuuuacagugcagucugaggcgcuccuggugagauaccgcaacacccugaccgggcagcuucucuucgaagccaaacuguacagcgagggauauauugcuguuuccuacucuggcagcgggccucugacauuucccaccgauggcuucuuugaagucguguccugggugccuagacucuuccagcuggccagcgucggaucucuugcuacaggccggacgcugaagcaauga

SEQ ID NO: 28130 - RNA, 1620 nt, Artificial Sequence
  derived and/or modified sequence opt5 from capsid_protein__Norovirus__ACL27297
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgccgauguuuucaccguguccagacgggugcugacacgccccagcccugacuuugauuucaucuuuucugucccgcccaccguggaauccagaacgaaaccuuucaccguucccauccucacaguggaggaaaugagcaacucucgguuuccuauuccccuggagaaacuuuacaccgggccguccagcgccuucgucgugcagccucagaauggacgcugcacaaccgacggcguucugcucgggacgacacaacugucugcugugaacaucuguaccuucagaggagaugucacacauaucgcgggcucccacgacuauaccaugaaucuggccagccagaacuggaauaacuacgaucccaccgaggaaauuccugcuccccucggcacaccugacuuuguggggaagauccagggaaugcugacgcagaccacacgggaggacggcuccacccgcgcccauaaggccacagucucuaccgggagcgugcacuucacgcccaaacuuggauccguucaauacacaaccgauaccaauaacgacuuucagacaggccagaauaccaaguucacaccggugggggucauucaagauggaaacaaucaccagaacgaaccucagcagugggugcugcccaauuauagcggcagaacgggccauaacguucaccucgcucccgccguggcgccuaccuuuccgggggagcaacugcuuuucuuucggucuacaaugcccggaugcuccggcuacccuaacaugaaucuggacugucuccugccccaggaauggguccagcauuucuaucaggaggcugccccugcccaaagcgauguggcucugcuccgcuuugugaaccccgacaccgggagaguucuguucgagugcaaacuucacaagucuggauacgucacaguggcccacaccggcccucaugaucuggugauucccccgaauggguauuuucgguucgacagcugggucaaccaguuuuacacgcucgcuccuaugggcaauggagccggcagacgccgggcgcuguga

SEQ ID NO: 28131 - RNA, 1623 nt, Artificial Sequence
  derived and/or modified sequence opt5 from capsid_protein__Norovirus__ACL27298
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaagauguuuucaccguguccugcagagugcugacacggccuagcccggacuuugauuucauuuuucucgugcccccuaccgucgagucucgcacgaaacccuucaccguuccuauccugacaguggaagagaugaccaauuccagauuucccauuccgcuugagaagcuguucacagggccuagcggagccuucgucgugcagccccagaacggccgguguaccacggacgggguucuccugggaacaacccaacugucuccugugaauaucugcacauuucgcggcgaugucacccauaucgccggcacccacgacuacacaaugaaccucgcuucccagaauuggaacaauuaugaucccacggaagagauuccugcgccccuggggaccccggacuucgugggaaaaauccagggcguccuuacacagaccacaagaggggacggaagcacccggggccauaaggccacggugucuacaggguccguucacuuuaccccuaagcugggaagcgugcaauucaccacagauaccaacaaugacuuugaaacaggccagaacacgaaauucacccccgucggcgugguucaggauggaaauuccacacaccaaaacgagccccagcagugggugcucccuaauuacucugggcgcaccggccauaacguccaccuggcuccggccguggcccccacauuuccuggggaacagcuucuguucuuuagaagcaccaugcccggauguuccggcuacccuaauaugaaccucgacugccugcugccccaagagugggugcagcauuucuaucaggaggcugccccugcgcagagcgauguugcucuccugcgguuugucaaccccgacacggggcgcgugcuuuucgaauguaagcugcacaaaucuggcuacgugaccgucgcccacacaggacaacaugaucucgugauuccgccuaauggcuauuuuagauucgacuccuggguuaaccaguucuacacccuggcccccauggggaauggagcuggccggagacgcgcccuuuga

SEQ ID NO: 28132 - RNA, 1623 nt, Artificial Sequence
  derived and/or modified sequence opt5 from capsid_protein__Norovirus__ACL27299
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaugaucgucgacgugagacaacucgagccugugcugauuccccugccugauguccggaauaacuuuuaucacuacaaucagucuaacgaccccaccaucaagcucauugcuaugcuguauacaccccuucgcgccaacaaugcuggcgaugacguuuucaccgugagcugcagagugcugacacggccuuccccggauuuugacuucaucuuucucgugcccccuaccgucgaaagccgcacgaaacccuucaccguuccuauucugacaguggaggaaaugaccaacucuagauuucccaucccgcuugagcggcuguacacagggccuuccagcgccuucgucgugcagccccagaauggacgcuguaccacggauggcguucuccuggggacaacccaacugucugccgugaacauuugcacauucagaggagacgucacccauaucgcuggcucccggaauuauaccaugaaccucgcgagccagaauuggucuaacuacgauccuacagaggaaauccccgccccucugggcacgcccgacuuuguggggaagauucagggaaugcuuacccagacaacccgcagagacggcuccacacgggggcacaaagcuaccguccugacgggaagcgccgauuucgccccgaagcucggccgcgugcaauuugcuacagacaccgauaaugacuucgaguccggggaaaacaccaaguuuacaccuguuggagugauccaggauggcucuaccacacauagaaaugagccccagcaauggguccugcccaacuacagcggccggacggggcacaaugugcaccuugccccugcgguugcuccgaccuaucccggagaacagcuccuguucuuuagauccacaaugccuggcuguagcggguaccccaacauggaccuggauugccugcucccucaggagugggugcgccauuucuaucaggaggccgcccccgcucaaucugacgucgcccugcuucgguuugugaauccugauaccggaagagugcuguucgaauguaaacuccacaaguccggcuacguuacagucgcucauaccgggcagcacgaccuggugauucccccgaacggcuauuuucgcuucgauagcugggugaaccaguuuuacacgcuugccccuaugggaaauggcgcggggcggagacgcgcccuguga

SEQ ID NO: 28133 - RNA, 1623 nt, Artificial Sequence
  derived and/or modified sequence opt5 from capsid_protein__Norovirus__ACL27300
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggucuaacuacgauccuacagaggaaauucccgccccucugggcacgcccgacuuuguggggaagauccagggaaugcuuacccagacaacccgcagagacggcuccacacgggggcacaaagcuaccguccugacgggaagcgccgauuucgccccgaagcucggccgcgugcaauuugcuacagacaccgauaaugacuucgaguccggggaaaacaccaaguuuacaccuguuggagugauucaggauggcucuaccacacauagaaaugagccccagcaauggguccugcccaacuacagcggccggacggggcacaaugugcaccuugccccugcgguugcuccgaccuaucccggagaacagcuccuguucuuuagauccacaaugccuggcuguagcggguaccccaacauggaccuggauugccugcucccucaggagugggugcgccauuucuaucaggaggccgcccccgcucaaucugacgucgcccugcuucgguuugugaauccugauaccggaagagugcuguucgaauguaaacuccacaaguccggcuacguuacagucgcucauaccgggcagcacgaccuggugauucccccgaacggcuauuuucgcuucgauagcugggugaaccaguuuuacacgcuugccccuaugggaaauggcgcggggcggagacgcgcccuguga

SEQ ID NO: 28134 - RNA, 1623 nt, Artificial Sequence
  derived and/or modified sequence opt5 from capsid_protein__Norovirus__ACL31312
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcacccaggaguacaccaugaaccucgcuucucagaauuggaacaauuaugaucccacagaagagauuccugcgccccugggcacgccggacuucguggggaaaauccagggaguccuuacccaaacaaccagacgggacggcuccacacgcgggcacaaggccaccgugagcacgggauccguucauuuuacaccuaagcugggccggauucaguucucuaccgauaccagcaacgacuuugaaacagggcagaauaccagauucacacccgugggagucgugcaagauggcuccacgacccaccagaacgagccccagcaguggguucucccugacuacagcggccgcgauucucacaaugugcaucuggcuccggccgucgcccccuccuuuccuggggaacaacuucuguucuuuagaagcacaaugcccggauguucuggcuacccuaacaugaaucucgacugccugcugccccaggagugggugcagcacuucuaucaggaggcugccccugcgcaaagcgauguggcucuccugcgguuuguuaaccccgacaccgggagaguccuuuucgaauguaaacugcauaaguccggauacgugacaguggcccacaccggccagcacgaucucgucaucccgccuaauggguauuuucgcuucgacucuugggugaaccaguucuacacgcuggcccccaugggcaacggaaccggccggagacgcgcucuuuga

SEQ ID NO: 28135 - RNA, 1623 nt, Artificial Sequence
  derived and/or modified sequence opt5 from capsid_protein__Norovirus__ACL31313
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagaggcgacgggucuacccggggacacaaggccacgguguccacaggcagcguucauuuuaccccuaagcugggguccgugcaguucucuaccgauacaagcaaugacuuugagaccggacagaacacacgcuucacgcccgucggcgugguucaagauggcuccaccacacaccagaaugaaccccagcagugggugcucccugcuuacagcgggagagacaaccacaauguccaucuggccccggccguggcucccaccuuuccuggagagcaacuucuguucuuucggucuacaaugcccggcuguuccggguacccuaacaugaaucucgauugccugcugccccaggaaugggugcagcacuucuaucaggagagcgccccugcgcaaucugacguugcucuccugcgcuuugucaaccccgauaccggaagagugcuuuucgaguguaaacugcauaagagcggcuacgugacggucgcccacaccgggcagcacgaccucgugauuccgccuaacggcuauuuucgguucgauuccuggguuaaucaguucuacacacuggcccccaugggaaacggcgcugggagacgccgggcccuuuga

SEQ ID NO: 28136 - RNA, 1623 nt, Artificial Sequence
  derived and/or modified sequence opt5 from capsid_protein__Norovirus__ACL31316
augaagauggccagcuccgacgcuacccccucugauggcagcacagccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgaccccacaauuaagcucaucgcuaugcuguauacaccccuucgcgccaauaacgcuggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaacagcagauuucccauuccgcuugagaagcuguucacagggccuucuuccgccuucgucgugcagccccagaauggacgguguaccacggauggcguucuccuggggacaacccaacugagcccugugaacaucugcacauuucgcggagacgucacccauaucgccggcacccagaauuacacaaugaaccucgcuucucagaauuggaacaauuaugaucccacggaggaaauuccugcgccccugggcaccccggacuucguggggaaaauccagggaaugccuacacaaaccacaagaggcgacggguccacccggggacacaaggccacggucagcacaggcuccgugcauuuuacccccaagcuggggucuguucaguucagcaccgauacauccaacgacuuugagaccggacagaauacacgcuucacgcccgugggcgucgugcaagauggcagcaccacacaccagaacgaaccucagcaguggguucuuccgaauuacucugggagagacucccacaacgugcaucucgcucccgccgucgccccuaccuuucccggagagcaacugcuuuucuuucggagcacaaugccuggcuguucuggguaccccaauaugaaccuggauugccuccugccucaggaaugggugcagcacuucuaucaggagagcgcucccgcccaauccgacguggcgcugcuccgcuuuguuaauccggauaccggaagaguccuguucgaguguaaacuucauaagucuggcuacgugacgguggcucacaccgggcagcacgaccuggucauuccucccaacggcuauuuucgguucgauagcugggugaaccaguucuacacacucgccccuaugggaaauggcgccgggagacgccgggcucuguga

SEQ ID NO: 28137 - RNA, 1623 nt, Artificial Sequence
  derived and/or modified sequence opt5 from capsid_protein__Norovirus__ACL31317
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucacacauaucgccggcacccaggaguacaccaugaaccucgcuucucagaauuggaacaauuaugaucccacagaagagauuccugcgccccugggcacgccggacuucguggggaagauccagggaguccuuacccaaacaacccggcgcgacggcuccacaagagggcacaaagccaccgugagcacgggauccguucauuuuacaccuaagcugggccggauucaguucucuaccgauaccagcaacgacuuugaaacagggcagaauacccgcuucacacccgugggagucgugcaagauggcuccacgacccaccagaacgagccccagcaguggguucucccugacuacagcggcagagaugggcacaaugugcaucuggcuccggccgucgcccccucuuuuccuggagaacaacuucuguucuuucgguccacaaugcccggcuguagcggguacccuaacaugaaucucgacugccugcugccccaggagugggugcagcacuucuaucaggaggcugccccugcgcaaucugauguggcucuccugagauuuguuaaccccgacaccggacgcguccuuuucgaauguaagcugcauaaaagcggcuacgugacaguggcccacaccgggcagcacgaucucgucaucccgccuaauggcuauuuucgguucgacuccugggugaaccaguucuacacgcuggcccccaugggaaacggcaccgggagacgccgggcucuuuga

SEQ ID NO: 28138 - RNA, 1623 nt, Artificial Sequence
  derived and/or modified sequence opt5 from capsid_protein__Norovirus__ACL31319
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugcuucuggccggcaacgcuuuuacggccgggaaaaucauuuucgcggccguuccucccaauuuuccuaccgagggacucucccccucucaggugacaauguucccgcauaucaucgucgacgugagacaacuggagccugugcugauuccccucccugauguccggaacaauuuuuaucacuacaaccagagcaaugaccccaccaucaagcugauugcuaugcuuuauacaccccugcgcgccaacaacgcuggcgaugacguuuucaccguguccugcagagugcucacacggccuagcccggauuuugacuucaucuuucuggugcccccuaccgucgaaucucgcacgaaacccuucuccguuccuauucuuaccguggaggaaaugacaaauagcagauuucccaucccgcuggagcggcuguucaccgggccuucuuccgccuucgucgugcagccccagaacggacgcuguacaaccgauggcguucugcuggggacgacacaacucagcccugugaauauuugcaccuuuagaggagacgucacacauaucgccggcacccaggaguacaccaugaaccuggcuucucagaauuggaacaauuaugaucccacagaagagaucccugcgccccuuggcacgccggacuucguggggaagauucagggaguccugacccaaacaacccggcgcgacggcuccacaagagggcacaaagccaccgugagcacgggauccguucauuuuacaccuaagcucggccggauccaguucucuaccgauaccagcaacgacuuugaaacagggcagaauacccgcuucacacccgugggagucgugcaagauggcggcacgacccaccagaacgagccccagcaguggguucugccugacuacuccgggagagauagccacaaugugcaucuugcuccggccgucgcccccucuuuuccuggagaacaacuccucuucuuucgguccacaaugcccggcuguagcggguacccuaacaugaaucuggacugccugcucccccaggagugggugcagcacuucuaucaggaggcugccccugcgcaaucugauguggcucugcuuagauuuguuaaccccgacaccggacgcguccuguucgaauguaagcuccauaaaagcggcuacgugacaguggcccacaccgggcagcacgaucuggucauuccgccuaauggcuauuuucgguucgacuccugggugaaccaguucuacacgcuugcccccaugggaaacggcaccgggagacgccgggcucuguga

SEQ ID NO: 28139 - RNA, 1623 nt, Artificial Sequence
  derived and/or modified sequence opt5 from capsid_protein__Norovirus__ACL31320
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucacacauaucgccggcacccaggaguacaccaugaaccucgcuucucagaauuggaacaauuaugaucccacagaagagauuccugcgccccugggcacgccggacuucguggggaagauccagggaguccuuacccaaacaacccggcgcgacggcuccacaagagggcacaaagccaccgugagcacgggauccguuaacuuuacaccuaagcugggccggauucaguucucuaccgauaccagcaaugacuuugaaacagggcagaacacccgcuucacacccgugggagucgugcaagauggcuccacgacccaucagaaugagccccagcaguggguucucccugacuacagcggcagagauucucacaacgugcaccuggcuccggccgucgcccccuccuuuccuggggaacaacuucuguucuuucggagcacaaugcccggauguucuggcuacccuaauaugaaccucgacugccugcugccccaggagugggugcagcauuucuaucaggaggcugccccugcgcaaagcgauguggcucuccugagauuuguuaaucccgacaccgggcgcguccuuuucgaauguaagcugcacaaauccggauacgugacaguggcccauaccggccagcacgaucucgucaucccgccuaacggguauuuucgguucgacucuugggugaaccaguucuacacgcuggcccccaugggcaauggaaccggcagacgccgggcucuuuga

SEQ ID NO: 28140 - RNA, 1623 nt, Artificial Sequence
  derived and/or modified sequence opt5 from capsid_protein__Norovirus__ACL31322
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucgccggcacccaggaguacaccaugaaccucgcuucucagaauuggaacaauuaugaucccacagaagagauuccugcgccccugggcacgccggacuucguggggaaaauccagggaguccuuacccaaacaaccagacgggacggcuccacacgcgggcacaaggccaccgugagcacgggauccguucauuuuacaccuaagcugggccggauucaguucucuaccgauaccagcaacgacuuugaaacagggcagaauaccagauucacacccgugggagucgugcaagauggcuccacgacccaccagaacgagccccagcagugggcucucccugacuacagcggccgcgauucucacaauguucaucuggccccggccguggcucccuccuuuccuggggaacaacuucuguucuuuagaagcacaaugcccggauguucuggcuacccuaacaugaaucucgacugccugcugccccaggaguggguccagcacuucuaucaggaggccgcgccugcucaaagcgauguggcccuccugcgguuugugaaccccgacaccgggagaguucuuuucgaauguaaacugcauaaguccggauacgucacaguggcccacaccggccagcacgaucucgugaucccgccuaauggguauuuucgcuucgacucuugggucaaccaguucuacacgcuggcucccaugggcaacggaaccggccggagacgcgcccuuuga

SEQ ID NO: 28141 - RNA, 1623 nt, Artificial Sequence
  derived and/or modified sequence opt5 from capsid_protein__Norovirus__ACL31324
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccauccugaccguggaggaaaugacaaauucuagauuuccuauuccccuugagcggcuguucaccgggccguccagcgccuucgucgugcagccucagaacggacgcuguacaaccgauggcguucuccuggggacgacacaacugucucccgugaauaucugcaccuuuagaggagacgucacacauaucgccggcacccaggaguacaccaugaaccucgcuucccagaauuggaacaauuaugauccuacagaagagauucccgcgccucugggcacgcccgacuucguggggaagauccagggaguccuuacccaaacaacccggcgcgacggcagcacaagagggcacaaagccaccguguccacgggaucuguucauuuuacaccgaagcugggccggauucaguucagcaccgauaccuccaacgacuuugaaacagggcagaauacccgcuucacaccugugggagucgugcaagauggcggcacgacccaccagaacgagccccagcaguggguucuccccgacuacagcgggagagauggacacaaugugcaucuggcuccugccgucgccccgucuuuucccggcgaacaacuucuguucuuucgguccacaaugccuggguguagcggauaccccaacaugaaucucgacugccugcugccucaggagugggugcagcacuucuaucaggaggcugcccccgcgcaaucugauguggcucuccugagauuuguuaacccugacaccggccgcguccuuuucgaauguaagcugcauaaaagcggguacgugacaguggcccacaccggccagcacgaucucgucauucccccgaauggauauuuucgguucgacuccugggugaaccaguucuacacgcuggccccuaugggcaacgggaccggaagacgccgggcucuuuga

SEQ ID NO: 28142 - RNA, 1608 nt, Artificial Sequence
  derived and/or modified sequence opt5 from capsid_protein__Norovirus__ACL31325
augaagauggccagcaacgacgcugcccccuccaaugauggcgcggcugggcuggugccugaggucaacaaugaaaccauggcccucgagccgguugugggagccucuaucgcugcuccccugacaggccagaacaaugugauugacccuuggaucagacuuaacuucguccaagcccccaauggggaauuuacggugagcccucggaacucccccggagagguucugcucaaucuggaacuuggcccugagcugaacccguaccucgcccaccugucucgcauguauaauggguacgcgggaggcguggagguccaggugcugcucgccggcaccgcuuucacagccgggaaacugguuuuugcugccgugcccccucauuucccccuugaaaacauuagcccuggacagaucaccauguuuccccacgucauuaucgaugugagaacacuggagccggugcuccugccucuucccgacguccggaauaacuucuuucauuauaaucagcaaaacgaaccucgcaugagacugguugcgaugcucuacacaccccugcgguccaacggcucuggggaugacguguucaccgugagcugccgcguccugaccagacccuccccugauuuugacuucaauuaucucgugccgcccacgguugagagcaagaccaaaccuuuuacacugcccauccuuaccauuggagagcugacaaacucucgguucccugugcccaucgaugaacucuacaccuccccgaaugagagccuggucgugcagccucagaacggccgcugugcccuugacggggaacugcagggaacgacacaacuccugcccaccgcuauuugcucuuuuagaggccggaucaaucagaagguuuccggcgagaaccacguguggaauaugcaggucacaaacauuaaugggaccccuuucgaucccaccgaagacgugccugcuccccugggaacaccggauuucagcggcaaacucuuugggguccugucucagcgcgaccaugccaacgccuguagaucccacgacgccgugaucgcuacgaauagcgcgaaguucaccccuaaacuuggagccauucaaaucggcacaugggagcaggaugacguucacaucaaccagcccaccaaguuuacacccguggggcuguucgagaaugaaggauuuaaccaauggacccucccuaauuauuccggcgcucugacgcuuaacaugggccuggccccgcccgucgccccuacauuccccggggagcagauucucuuuuuccggucucauaucccucugaagggaggcguggcugaucccguuauugacugccugcucccucaggaauggauccagcaccuguaccaagagagcgcccccucccagaccgauguggcgcuuauucgcuuuaccaacccggacacagggagaguccuguucgaagcuaaacuccaucggagcggauacaucaccguggccaauacaggcucuagaccuaucgugguucccgccaacggguauuuucgcuucgauuccugggucaaucaguuuuacagccuggcuccuaugggcacgggaaacggccggagacgcgugcaguga

SEQ ID NO: 28143 - RNA, 1629 nt, Artificial Sequence
  derived and/or modified sequence opt5 from capsid_protein__Norovirus__ACL31326
augaagauggccagcaacgacgcugcccccuccaaugauggcgcggcuucucuggugccugagggggucaacgaaaccaugccgcucgagcccguugccggagccagcaucgcugccccuguggcuggccagacaaauauuaucgaccccuggauuagaacgaacuucgugcaagccccuaauggggaauuuaccgucucuccccggaacuccccuggagagauccugcuuaaucuggaacucggcccggaucugaaccccuaccuugcgcaccugagccgcauguauaauggguacgccggaggcguggagguucaggugcuccuggcuggcaacgccuucacagcugggaaaauucuguuugccgcgaucccucccaauuucccugucgacaugaucucccccgcccagauuaccaugcucccgcaucugaucguggauguuagaacacuugagccuauuaugaucccccugccugacgugcggaacgucuuuuaucacuucaauaaccagccccaaccccgcaugagacucguggcuaugcuguacaccccucuucggucuaauggaagcggcgaugacguguuuacagucuccugccgcguucugaccagaccgacgcccgauuucgaauuuauuuaucucgugccucccagcguggagucuaagaccaaaccuuucacacugcccauccugaccauuuccgaacucacaaacagccgguuuccgaucccuaucgagcagcuguacaccgcccccaacgagacgaaugucgugcagugucagaacgggcgcugcacacuugacggagaacugcaaggcaccacacagcuccugucuuccgcuguuuguagcuauagagggcggaccguggccaauucuggagauaacugggaccagaaucuucugcagcucaccuacccuaacggcgccuccuacgaucccacagacgaggucccugcuccccugggcacgcaagacuucagcgggaugcuguauggagugcucacccaggauaauguuaacguguccacaggcgaagcgaagaaugccaaagggauuuacaucucuaccacaagcggaaaguuuaccccgaagauuggcuccaucgggcugcauagcauuacggagcacguccauccuaaccagcaaucucgcuucacacccgugggagucgcugugaaugaaaacacccccuuccagcaguggguucuuccucacuaugccggcucccuggcccucaauaccaaccuggcuccggccguggcgcccacauuuccuggcgagcagcuucuguucuuuagaagccggguccccugcgugcaagggcuccagggacaggacgcuuucaucgauugucugcugccucaggaguggguuaaucacuuuuaccaagaagccgcccccucucaggcugacguggcccucauccgcuaugucaacccugauaccggcagaacacuguucgaggcuaaacuucaucggagcggguuuauuacggugucccacaccggagccuacccccuggugguuccgccuaacggccauuucagauuugacucuugggucaaucaguucuauagccucgcgcccauggggacaggcaacggacgccggagagugcaguga

SEQ ID NO: 28144 - RNA, 1623 nt, Artificial Sequence
  derived and/or modified sequence opt5 from capsid_protein__Norovirus__ACL31340
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccugagccgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaauagcagauuucccauuccgcuugagaagcuguucacagggccuucuuccgcuuucgucgugcagccccagaacggacgguguaccacggauggcguucuccuggggacaacccaacugagcccugugaauaucugcacauuucgcggaaacgucaccaauaucgccggcucucagaccuacacaaugaaccucgccucccagaauuggaacaauuaugaccccacggaggaaauuccugcuccccugggcaccccggauuucguggggaaaauccagggaguccuuacacaaaccacaaagggcgacgggagcaccagaggacauaaggcgacgguguccacaggcucugcccaguuuaccccuaaacuggggagcguucaguucuccaccgacacaagcaccgauuuugagacaggacaaaacacgcgguucacccccgugggcgucauucaggacggcucuacaacccacaagaaugaaccccagcagugggugcucccuuccuacagcgggcgcgauucucauaacguucaccuggcuccggccguggcccccacauuuccuggagagcaaauccuuuucuuuagaagcaccaugcccggcuguuccggguacccuaauauggaccuggauugccuccugccccaggaauggguccagcacuucuaucaggagucugcuccugcccaaagcgacguggcgcugcuccgguuugugaaccccgauacgggacgcguucuguucgaguguaaacuucauaaguccggcuacgucaccguggcucacacagggcagcaugaccuggugauuccgccuaauggcuauuuuagauucgauagcugggucaaccaguucuacacccucgcccccaugggaaacggcgccgggcggagacgcgcucuguga

SEQ ID NO: 28145 - RNA, 1623 nt, Artificial Sequence
  derived and/or modified sequence opt5 from capsid_protein__Norovirus__ACL31354
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagcucaaugacagcacaauuaagcugaucgccaugcuuuauacaccccugcgcgcuaacaacgccggcgaagauguuuucaccguguccugcagagugcucacccggcccagcccugacuuugauuucauuuuucuggucccgcccacaguggagucucgcaccaaaccuuucacgguucccauccuuaccguggaagagaugacaaauuccagauuuccuauuccccuggagaaacucuucaccgggccgagcggagccuucgucgugcagccucagaacggccgguguacaaccgacgggguucugcugggaacgacacaacucucucccgugaauaucugcaccuuucgcggcgaugucacacauaucgcuggcuccagagacuacaccaugaaccuggcgagccuuaauuggaacaauuaugauccuaccgaagagauucccgccccucuggggacacccgacuucgugggaaagauccagggcguccucacgcagaccacaaagggggacggaucuacccggggccacaaggcuacaguguacaccggguccgccccguuuacgccuaaacugggaagcguucaguucuccacagauaccgaaaacgacuuugagacccaucaaaauacaaaguucacccccgugggcgucauucaggauggcucuacaacgcaccgcaacgaaccccagcaaugggugcuuccuagcuacuccgggagaaauguucacaacgugcaucuggccccggcugucgcccccaccuuuccuggagagcagcuccuguucuuucggagcacaaugcccggcuguucuggguauccuaauauggaccuggauugccuccugccccaggagugggugcagcacuucuaccaagaagcggcuccugcccaguccgacguggcccuucugcgcuuuguuaaccccgauaccggaagaguccucuucgaguguaaacugcauaagagcggcuaugugacaguggcucacaccgggcagcacgaccuugucaucccgccuaauggcuacuuucgguucgauucuugggugaaccaguucuauacgcuggcccccaugggaaacggcaccgggagacgccgggcucucuga

SEQ ID NO: 28146 - RNA, 1623 nt, Artificial Sequence
  derived and/or modified sequence opt5 from capsid_protein__Norovirus__ACL31355
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggacacccgauuucgugggaaaaauccagggcguccugacgcagaccacaaagggggacggauccacccggggccacaaggcuacaguguacaccgggagcgccccguuuacgccuaaacucggauccguucaguucucuacagacaccgaaaaugauuuugaggcccaucaaaacaccaaguucacacccgugggcgucauucaggacggcgggaccacacaccgcaaugaaccccagcaaugggugcugccuagcuacuccggaagaaacguucacaaugugcaucuugcuccggccgucgcgcccacguuuccuggcgagcagcuccuguucuuucggagcaccaugcccggguguucuggauauccuaacauggaucuggacugccugcucccccaggagugggugcagcacuucuaccaagaagcugccccugcccaguccgauguggcucugcuucgcuuuguuaaucccgacacaggcagaguccuguucgaguguaaacuccauaagagcggguaugugaccguggcccacacaggccagcacgaucuggucaucccgccuaacggauacuuucgguucgacucuugggugaaccaguucuauacccuugcucccaugggcaaugggacgggaagacgccgggcccuguga

SEQ ID NO: 28147 - RNA, 1623 nt, Artificial Sequence; identical to SEQ ID NO: 26922
  derived and/or modified sequence opt5 from capsid_protein__Norovirus__ACL31356

SEQ ID NO: 28148 - RNA, 1623 nt, Artificial Sequence
  derived and/or modified sequence opt5 from capsid_protein__Norovirus__ACL31358
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucauccauauugcuggcagcagaaacuacacaaugaaucucgcgucucugaacuggaauaacuaugacccuaccgaagagauccccgccccucuugggacccccgauuucgugggaaaaauucagggcguccugacacagacgaccaagggggacggauccacacggggccacaaggcuaccguguacacagggagcgccccguuuaccccuaaacucggauccguucaguucucuacggacacagaaaaugauuuugaggcccaucaaaacaccaaguucacccccgugggcgucauccaggacggcgggacaacccaccgcaaugaaccccagcaaugggugcugccuagcuacuccggaagaaacguucacaaugugcaucuugcuccggccgucgcgcccacauuuccuggcgagcagcuccuguucuuucggagcacgaugcccggguguucuggauauccuaacauggaucuggacugccugcucccccaggagugggugcagcacuucuaccaagaagcugccccugcccaguccgauguggcucugcuucgcuuuguuaaucccgacaccggcagaguccuguucgaguguaaacuccauaagagcggguaugugacaguggcccacaccggccagcacgaucuggucauuccgccuaacggauacuuucgguucgacucuugggugaaccaguucuauacacuugcucccaugggcaaugggaccggaagacgccgggcccuguga

SEQ ID NO: 28149 - RNA, 1647 nt, Artificial Sequence
  derived and/or modified sequence opt5 from capsid_protein__Norovirus__ACL31361
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgauagcaccacacgcgcccaugaggcgaaaaucgacacgaccuccgggagauuuacaccgaagcucggaagccuggaaauuucuaccgaguccgaugacuucgaucagaauaagccuacacgguuuacccccgugggcaucgggguugaccacgaagcugauuuccagcaaugggcccugcccgacuacgccggacaguuuacgcacaacaugaaucucgcuccugccguggcuccgaacuuccccggcgagcagcugcuguuuuucagaagccagcuuccuucuagcggcgggcgcuccaauggaauccucgauugccuggucccccaagagugggugcagcauuuuuaccaggaaucugccccuagccagucccaagucgcgcuugugcgguauauuaaccccgacacaggcagaguucuguucgaggccaaacuccacaagcugggguuuaucaccauugcuaaaaacggagacagcccuaucaccgugcccccgaauggcuacuuccgcuucgaaucuugggucaacccuuuuuauacacuggcccccauggggaccggcaauggacggagacgcauucaguga

SEQ ID NO: 28150 - RNA, 1623 nt, Artificial Sequence
  derived and/or modified sequence opt5 from capsid_protein__Norovirus__ACL31365
augaagauggccagcaacgacgcuaaucccuccgauggcucugccgcgaaccuggugccugaggucagcaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagccacaacuacaccaugaaucucgcgucucugaacuggaauaacuaugacccuaccgaagagauucccgccccucuugggacacccgauuucgugggaaaaauccagggcguccugacgcagaccacaaagggggacggauccaccagaggccauaaggcuacaguguacaccgggagcgccccguuuacgccuaaacucggauccguucaguucucuacagacaccgaaaaugauuuugagacccaccaaaacacaaaguucacccccgugggcgucauucaggacggcagcacaacgcaccggaaugaaccccagcaaugggugcugccuuccuacagcgggucuaacguucauaaugugcaccuugccccggcugucgcccccaccuuuccuggagagcagcuccuguucuuucgcuccacaaugcccggcuguagcggguauccuaacauggaucuggacugccugcucccccaggagugggugcagcauuucuaccaagaagcggcuccugcccagucugauguggcccugcuuagauuuguuaaucccgacaccggacggguccuguucgaguguaaacuccacaagagcggcuaugugacaguggcucacaccgggcagcaugaucuggucaucccgccuaacggcuacuuucgcuucgacuccugggugaaccaguucuauacgcuugcccccaugggaaauggcaccgggagacggagagcucuguga

SEQ ID NO: 28151 - RNA, 1623 nt, Artificial Sequence
  derived and/or modified sequence opt5 from capsid_protein__Norovirus__ACL36375
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgaccccacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagaggugccugcuccccuuggcacaccggauuucgucgggaaaauucagggagugcugacgcagaccacaaagggcgacgggucuacccggggacacaaggccacaguuuacaccggcuccgccccuuuuacgcccaaacucgggagcgugcaguucuccacagacaccgaaaacgauuuugagacccaucaaaauacaaaguucacccccgucggagugauccaggacggcucuacaacgcaccgcaacgaaccucagcaauggguucugccgagcuacuccggcagaaaugugcagaacguccaccuugcccccgcuguggccccuaccuuucccggggagcagcuccuguucuuucggagcacaaugccuggauguucuggcuaucccaauauggaucuggacugccugcucccucaggagugggugcaacauuucuaccaggaagcggcucccgcccaguccgauguugcccugcuucgcuuugucaacccggacaccgggagagugcuguucgaguguaaacuccacaagagcggauaugugacagucgcucauaccggccagcacgaucuggugauuccucccaacggguacuuucgguucgacucuuggguuaaucaauucuauacgcuugccccuaugggcaacggaaccggcagacgccgggcucuguga

SEQ ID NO: 28152 - RNA, 1593 nt, Artificial Sequence; identical to SEQ ID NO: 28065
  derived and/or modified sequence opt5 from capsid_protein__Norovirus__ACN32270

SEQ ID NO: 28153 - RNA, 1608 nt, Artificial Sequence
  derived and/or modified sequence opt5 from capsid_protein__Norovirus__ACT52403
augaagauggccagcaacgacgcuucccccucuagcgauggcuccgccaaucuggugccugagaucaacaaugaagucauggcgcucgagccgguugcuggggccgccauugcugcccccguggcuggacagcaaaacaucauugacccuuggaucagaaauaacuucgugcaggcccccggcggggaauuuaccgucucuccucggagcgcgcccggagaggugcugcuuaaucugccucucuccccggauauuaaccccuaccuggcccaccuuucucgcauguauaauggcuacgcugggggaguugaaguggaggucgugcuggccggcaacgcuuucacagccggcaaaaucaucuuugcggccguuccucccaauuucccucccgagaaccucagcccgucccagauuacgaugcugccucauaucauuguggacgucagacagcuggaacccgugcggaucccucuccccgaugugcgcaauaacuuuuaucacuacagcagagagaaugacucuacccugcggcuuauugcuaugcuguauacaccccuccgcgccaacaacgcuggggaugacgucuucaccguuuccugcagagugcugacacggccuagcccggauuuugacuucaucuuucuugugcccccuaccgucgaaucuaaguccaaacccuucacaauuccuauccugaccaucgaggagaugacgaauagccgcuuucccgccccgcucgaaaugaugaccacaggaccuucucaugauauugugguucaaccccagaacggcagauguaccaucgacggggugcugcugggaacaacccagcucuccccugucaauauuugcagcaugcggggcgugcccacgaagcgcacaaacgggaccgauaauuguuucguucagcuggagaacccuaauggauccgccuacgaccccacagaagacaucccggcugugcuuggcucuccugauuuugucggcgaguucuaugggaccauuacccaaagaagccccaacaauuccacacgggcgcaccccuucacgcugaacaccggaagcccucgcuacacaccgaaaaucggcucuguggacauccaugucaccgauguggaagaccucaaugaucacgagcccguuaagcugacaccuguggggcuuuccggaagcucuggcagcauucaccaguggcagcugcccaacuacuccggggucgccacccauaauaugcaccucgcuccuucuguggcuccccuguuuccuggagagcagauccuguucuuuagaagcacgguucccggcugcggcggguauccgaacacaaauauugacugucucaucccucaagaaugggugcagcauuucuaccaggagggagcccccgcccggaccgaugucgcccugcuuagauuuauuaacccugacaccggccgcgugcuguucgaaugcaagcuccacaaacacggguuuaucacaguggcguauuccggaaaccaugaucugguuaugcccccgaauggcuacuuccgguuugagagcugggucaaccaauuccacacccuugcuccuauggggacaggcucuggaagacgccggauccaguga

SEQ ID NO: 28154 - RNA, 1647 nt, Artificial Sequence
  derived and/or modified sequence opt5 from capsid_protein__Norovirus__ACT52405
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucauggacaauuucguucaggcccccgggggagaguuuacggugucuccuagaaacagccccggcgaagugcuucugaaucucgagcuggggccugaaauuaacccguaccuugcccaccuggcucggauguauaauggauacgccggcggcuucgagguccaggugguucucgcugggaacgccuuuaccgcgggaaaaaucaucuucgccgcuauucccccuaauuuucccaucgauaaccuguccgccgcucagauuacaaugugcccucaugugaucgucgacgugcgccaacuggagcccguuaaucucccgaugccugaugugagaaacaauuucuuucacuauaaccagggcucugacagccggcugcgccuuauugccaugcuguacacaccccucagagccaacaauuccggggaugacgucuucaccgugucuugucgggugcugacccgcccuagccccgauuuuuccuucaacuuucuuguucccccuacagucgaaagcaagaccaaaccguucacgcugcccauccucaccauuucugagauguccaauagcagauuuccugugcccaucgacucucugcauacauccccuaccgauaacaucgugguccagugccagaauggacgggugacacuggacggcgaacucauggggaccacgcaacugcuucccagccagauuugugcuuuccgcggaguucugacaagaucuaccucccgggcgagcgaccaggccgauacagcuaccccgcgccucuucaacuauuacuggcacauccagcuggacaaucuuaacggcaccccuuaugaucccgccgaggacauuccuggcccccuggggacaccugauuuuagaggaaagguguucggcgucgccucccaacggaaucccgacucuacgacccgcgcucaugaggccaaaguggauacaaccgcggggagauuuacaccgaagcucggaagccuggaaaucuccaccgagagcaacgacuucgaucagaaucagccuacgcgguuuacacccguuggcauugggguggaccacgaagcugauuuccaacaguggucucugcccgacuacuccggacaguuuacccacaacaugaaucucgucccugccguggccccgaacuuccccggcgagcagcugcuguuuuucagaagccaacuuccuucuagcggcgggcgcuccaauggaauccucgacugccuggucccccaggaaugggugcagcauuuuuaccaggagucugcuccugcccaaacccagguugcucuugugcgguaugucaaccccgauacaggcagagugcuguucgaggccaagcuccacaaacugggguuuaugaccaucgcgaagaacggagacagcccuauuacaguucccccgaauggcuacuuccgcuucgaauccugggugaacccuuuuuauacgcuggcccccauggggaccggcaauggacggagacgcaaccaguga

SEQ ID NO: 28155 - RNA, 1647 nt, Artificial Sequence
  derived and/or modified sequence opt5 from capsid_protein__Norovirus__ACT52407
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuuucccaccuggcccggauguauaacggauacgcuggcggcuucgagguccaggugguucucgccgggaaugcuuuuaccgccggaaaaaucaucuucgcggccauucccccuaacuuucccaucgacaaucugucugcugcccagauuacaaugugcccucaugugaucgucgaugugcgccaacuggagcccguuaaccucccgaugccugacgugagaaauaacuucuuucacuauaaccagggcagcgauucccggcugcgccuuauugcuaugcuguacacaccccucagagccaauaacucuggggacgaugucuucaccgugagcugucgggugcugacccgcccuucccccgacuuuagcuucaauuuucuuguucccccuacagucgaaucuaagaccaaaccguucacgcugcccauccucaccauuuccgagaugagcaacucuagauuuccugugcccaucgauucccugcauacaagcccuaccgaaaauaucgugguccagugccagaacggacgggugacacuggacggcgagcucauggggaccacgcaacugcuucccucucagauuugugccuuccgcggaguucugacaagauccaccagccgggcuuccgaucaggcggacacagccaccccgcgccucuucaauuauuacuggcacauccagcuggacaaccuuaauggcaccccuuaugaucccgcugaggacauuccuggcccccuggggacaccugauuuuagaggaaagguguucggcgucgccucucaacggaaccccgacagcacgacccgcgcccaugaagcuaaaguggauacaaccgccgggagauuuacaccgaagcucggaucccuggagaucagcaccgaaucugacgauuucgaccagaaucagccuacgcgguuuacacccguuggcauugggguggaucacgaggcggacuuccaacaguggucccugcccgauuacagcggacaguuuacccacaacaugaaucucgcuccugccgucgccccgaacuuccccggcgaacagcugcuguuuuucagaucucaacuuccuagcuccggcgggcgcucuaauggaauccucgacugccuggugccccaggaguggguccagcauuuuuaccaggagagcgcuccugcccaaacccagguggcucuuguucgguaugugaaccccgacacaggcagaguccuguucgaagccaagcuccacaaacugggguuuaugaccaucgcgaagaacggagauuccccuauuacagugcccccgaauggcuacuuccgcuucgagagcuggguuaacccuuuuuauacgcuggcccccauggggaccggcaauggacggagacgcaaccaguga

SEQ ID NO: 28156 - RNA, 1608 nt, Artificial Sequence
  derived and/or modified sequence opt5 from capsid_protein__Norovirus__ACT52409
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagagauucuucugaaucucgaacugggcccugagcuuaacccguuccuggcgcaccucucucgcauguacaauggguaugccggaggcguggagguucaggugcugcuggcuggcaacgccuuuaccgcugggaaacucgucuucgccgcgauucccccucauuuucccaucgaaaaucugagcccuggacagaucacaauguucccccacgugaucauugauguuagaacccuugagccggugcugcucccucugcccgacguccggaacuccuuuuuccauuacaaucaggaaccugagccccgcaugagacuuguggccaugcuguauacaccccuccggucuaacggcagcggggaugacguguuuaccgucuccugccgcguucugacaagaccuagcccggauuucgacuuuaacuaccuggugcccccuaccguggagucuaagacgaaacccuucacccucccuauccugacaauuggagaacuuuccaauagccgguuucccgcuccgaucgaugagcuguauaccucuccuaacgaaggccucgucgugcaaccccagaaugggcgcuccacacuggacggagagcuucugggcaccacgcagcucguuccuagcaacauuuguucucugagaggccggacaaaugcccaccuucccgauaaccagcaucgcuggaauaugcaagugaccaacccuaaugggacacccuucgacccgaccgaagaugucccugcuccccucggaacccccgacuuccuggccaacaucuacggcgugacaucccagagaaauccuaacaauacgugccgggcccacgacgggauucuugcuaccuggagcccgaaguuuacacccaaacugggauccguugugcucggcaccugggaggaucgcgacuucgauaucaaccagccuacaagauuuacccccgucgggcuguaugacacggaucacuucaaucagugggcgcuuccuaacuacucuggagcccugacacucaacaugaaucuggcucccagcguggccccucuguuucccggcgagcaacuccuguucuuucggucccauaucccgcuuaagggcgggaccagcaacggagccauugacugucugcucccucaggaauggguccagcacuucuaccaagagucugcucccuccagcaccgauguggcccugaucagauauacaaauccugacaccggccgcguucuguuugaagcgaagcugcaucggcagggguucauuacagugucuaacagcggauccagacccaucgucgugccgccuaauggcuacuuucgcuucgauucuuggguuaaccaguuuuauagccucgcucccauggggacgggcaauggacggagacgcgugcaguga

SEQ ID NO: 28157 - RNA, 1623 nt, Artificial Sequence
  derived and/or modified sequence opt5 from capsid_protein__Norovirus__ACT78459
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgaucaugacuuugaugcuaaucagaauacaaaauucacccccgugggggucauucaggacggagauacagcccaccggaacgagccccaacagugggugcucccuucuuacagcggccgcaauucccacaacguucaucuggcgccggcuguggcccccacguuuccuggcgaacagcuucuguucuuuagaagcaccaugcccggguguucuggauauccuaauauggaccucgauugccugcugccccaggaguggguccaauacuucuaucaggaagccgcuccugcccaguccgacguggcucuccugcgguuugugaaccccgauacaggcagaguucuuuucgaguguaagcugcacaaaagcggguacgucaccguggcccauacaggacagcacgaccucgugaucccgccuaauggcuauuuucgcuucgacucuugggucaaccaauucuacacccuggcgcccauggggaacggcacgggacggagacgcgcccuuuga

SEQ ID NO: 28158 - RNA, 1641 nt, Artificial Sequence
  derived and/or modified sequence opt5 from capsid_protein__Norovirus__ACU56258
augaugauggccagcaaggacgcuccccaguccgccgauggcgcgucuggggcuggacaacuggugccugaggucaacaccgccgacccgcuccccauggaaccuguugccggccccacaacggcuguggccaccgcuggacaggugaauaugaucgauccuuggauugucaacaauuucgugcagagcccccagggggaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcugugugcccccuggauuuacaucuagcucccugaccaucgcucaggccacacuguucccccacguuauugcugacgugcgcacccucgaaccgaucgagaugccucuggaagaugucagaaacgugcuuuaucauacgaaugacaaccagcccaccaugcggcuggugugcaugcucuacacaccucugcgcaccggcgggggaagcggcaauucugauuccuuugucguugccgggagagugcuuacagcgcccagcucugacuucuccuuucuguuccucgugcccccuaccauugagcaaaagacgcgggccuuuacagucccgaacaucccccugcagacccugagcaauucucgcuucccuucccucauucagggaaugauccugagccccgaugcuucccaggugguucaauuucagaacggcagaugucuuauugacggccagcugcucgggacaaccccugccaccucuggacaacuguuccgggugcgcggcaaaaucaaccagggggcuagaacacuuaaucugacggaggucgauggaaagcccuucauggccuuugacagcccggccccugugggcuuccccgacuuugggaaaugcgauuggcacaugcggaucuccaagaccccuaacaauacaagcucuggagaccccaugcgcuccguugaugugcagaccgacguccagggcuucgugccucaucucggcagcauucaauuugaugaagucuucaaccaccccacaggggacuauaucggaaccauugaguggaucucucagccgagcacgccucccggcacagauauuaaucugugggaaauccccgacuacggguccucucugagccaggcugcgaaccucgccccuccgguguuucccccuggauucggcgaggcucugguuuauuuuguguccgccuuccccgggccuaauaacagaagcgcccccaaugaugucccuugucuucugccccaggaguacgugacccacuuuguuucugaacaagcuccgaccaugggcgacgccgcgcuccugcauuauguggauccugacacaaaccggaaucuuggagaguucaagcuguaccccggcggguaccugaccugcgucccuaacggagugggcgcugggccccagcagcucccgcugaauggaguguuucucuucguuuccugggucagccgcuucuaucagcugaaaccugugggcacagccucuacggccagagggcggcuuggcgugagacgcaucuga

SEQ ID NO: 28159 - RNA, 1638 nt, Artificial Sequence
  derived and/or modified sequence opt5 from capsid_protein__Norovirus__ACX33982
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaauuuaccauuagcccuaauaacacacccggcgaugugcucuuugaccugcagcuugggccucaccugaauccguuccucucccaucuggcccaaauguauaacggaugggucggcaauaugaaagugaagguucuucuggccggcaacgcuuuuaccgccgggaaaaucauuaucucuugcauucccccuggauucgcggcccagaauuuuagcauugcucaggccacaauguucccccacgugaucgcugaugucagagugcucgagccuauugaaguuccccuggaggacgugcggaacguccuguuucauaauaacgauaauaccccgacgaugcgccucguguguaugcuguacaccccucuuagagccuccggcucuagcuccgggacagaccccuucgugaucgccggacggguccugaccugcccuagccccgauuuuucuuuccucuuucugguucccccuaacguggagcagaagacaaaaccguucuccgugcccaaccuuccucugaauacccucagcaacucucgcguccccucccugauuaagagcaugaugaucucuagagaccacggccaaauggugcaguuucagaaugggcggguuacgcuggauggacagcuccaaggcacaaccccuacauccgcuagccagcuguguaagauucgcggcuccguguuccaugcgaacgggggaaauggcuauaaccuuaccgaacuggacgggucucccuaccacgccuucgagagcccggcuccuaucggauuucccgaucucggcgaaugcgacuggcacauggaggccuccccuaucacccaguucgacacaggggaugucauuaaacaaaucaaugugaagcaggagagcgccuuugcuccccaucugggaacgguucaggccgacggccuuucugauguguccgcgaacaccaauaugauugcuaaacugggcugggucagcccugugucugacgggcacagaagcgaugucgaccccugggugaucccgcgguauggauccacacucaccgaagccgcccagcuggcuccucccauuuaucccccuggcuucggggaggccaucguuuucuucaugucugauuuuccgaucgcucauggaacaaacggccugagcgugcccuguaccauuccucaagaguucgucacgcacuuugugaaugaacaggcccccacacgcggggaagcggcccuccugcacuaccuugacccugauacccauagaaaccugggcgaguucaagcucuaccccgacggauuuaugaccugcguuccuaauuccagcggcacagggccccagacccugccgaucaacggaguguucgucuuugugucuugggugucccgguucuaccagcuuaaaccuguuggcacagcugggcccgcccgcagacugggaauccggcgcagcuga

SEQ ID NO: 28160 - RNA, 1638 nt, Artificial Sequence
  derived and/or modified sequence opt5 from capsid_protein__Norovirus__ACX33983
augaugauggccagcaaggacgcucccaccaacauggauggcacauccggggccggacagcuggugccugaggcgaauacggcugaaccgaucucuauggagcccgucgccggcgccgcuaccgccgcugccacagcggggcaaguuaacaugauugacccuuggaucaugaauaacuacgugcaggcuccccagggagaguucaccauuagcccuaauaacacacccggcgaugugcucuuugaccugcagcuugggccucaccugaauccguuccucucccaucuggcccaaauguauaacggaugggucggcaauaugaaagugaagguucuucuggccggcaacgcuuuuaccgccgggaaaaucauuaucucuugcauucccccuggauucguggcgcagaauuuuagcaucgcccaggcuacaauguucccccacgucaucgccgaugugagaguucucgaaccuauugaagugccccuggaggacguccggaacgugcuguuucauaauaacgauaauaccccgacgaugcgccucguguguaugcuguacaccccucuuagagcuggcggguccucuagcggaacagaccccuucgucaucgccggccggguucugaccugcccuucccccgauuuuagcuuccucuuucuggugcccccuaacguggagcagaagacaaaaccguucucuguccccaaccuuccucugaauacccucuccaacagccgcgugcccucucugauuaaguccaugaugaucagcagagaccacgggcaaaugguucaguuucagaauggacgggugacgcuggauggccagcuccaaggcacaaccccuacaucugccucccagcuguguaagauucgcgggagcgucuuccaugcuaacggaggcaauggguauaaccuuaccgaacuggacggaucccccuaccacgcguucgagucuccggccccuaucggcuuucccgaucucggggaaugcgacuggcacauggaggcuagcccuaccacacaguucgacacgggagaugugaucaaacaaauuaauguuaagcaggaguccgccuuugcuccccaucugggcaccgugcaggccgacggccuuagcgaugucucugccaacacaaauaugaucgcgaaacugggguggguguccccugucagcgacggacacagaucugauguggaccccuggguuauuccgcgguauggcagcacccucacagaagcugcccagcuggccccucccaucuaucccccuggguucggagaggcuauuguguuuuucauguccgauuuuccgaucgcccauggcaccaacgggcugucuguccccuguacgaucccucaagaguucgugacacacuuuguuaaugaacaggcucccacccgcggcgaagccgcgcuccugcacuaccuugacccugauacccauagaaaccugggagaguucaagcucuaccccgacggcuuuaugacaugcgugccuaauagcuccgggaccggaccccagacacugccgauuaacggcgucuucguguuugugagcuggguuucucgguucuaccagcuuaaaccugucgggacggccggacccgcucgcagacugggcauccggcgcuccuga

SEQ ID NO: 28161 - RNA, 1611 nt, Artificial Sequence
  derived and/or modified sequence opt5 from capsid_protein__Norovirus__ACX81341
augaagauggccagcaacgacgcuacccccuccgaugacggcgccgcggggcuggugccugagaucaauaacgaagucauggcucucgagccgguugccggagccucuauugcugcccccguggugggccagcaaaauaucauugauccuuggaucagaaacaauuucguccaggcucccgccggggaauuuacagugagcccucggaacucccccggagagcugcuucuggaccucgaacugggcccugagcuuaauccguaccuggcgcaccucgcccgcauguauaacgggcaugcuggaggcauggagguucagauugugcuggccggcaaugcuuucacggccgggaaaauccuguuugcggccauucccccuucuuuccccuacgaaaaccucagcccugcucagcugaccaugugcccccacgucaucguggauguuagacaacuugagccggugcugcucccuaugcccgacauccggaaugucuuuuaucauuacaaccagaauaacuccccuaagcugcgccuuguggccaugcuguauacaccccucagagcuaauaacucuggagaugacguguucaccgucagcugucggguucugacacgccccuccccugauuuucaguucaccuuucuggugccgcccacaguggaaagcaaaaccaagaacuucacgcucccuguccugagagugucugagaugaccaauucccgguuucccguugugcuugaccagauguacacaagccgcaacgagaauauuaucguccaaccucagaacggcagaugcaccacagauggggaacugcucggaaccacgauucugcagucuguguccaucuguaauuucaaaggcacaaugcaggccaaacuuaacgaggaaccccgguaucaacugcagcucaccaaucuggacgggagcccgauugauccuacagacgacaugcccgccccucugggaacccccgauuuucaggcuaugcucuacggcguugcgucucaacgcuccagcaucgacaacgccaccagagcucacgaugcccagaucgacacagccggcgauacguucgcuccuaagauuggacaggugcgguucaaguccucuagcaaugacuuugaucugcaugaccccaccaaguucacaccgaucggggucaacguggaugaccagcacccuuuucgccaauggucccuucccaauuacggcgggcaccuggcccucaacaaucaucuggcgcccgcugucaccccucuuuucccgggagagcagauucuguuuuucagaagcuauauccccucugccggcgggcacacagauggagccauggacugccuccugccucaggaauggguggagcauuuuuaccaggaggcugcccccucccaaagcgacauugcucugguucgguucaucaacccugauaccggcagagugcucuuugaagccaaacugcacaagcagggcuuccuuacgaucgcggccucuggggaccaccccauugucaugccuacaaauggauauuuucgcuucgaggcuugggugaaccccuuuuacacccuggccccgguuggcaccgggagcggacggagacgcauccaguga

SEQ ID NO: 28162 - RNA, 1611 nt, Artificial Sequence; identical to SEQ ID NO: 28161
  derived and/or modified sequence opt5 from capsid_protein__Norovirus__ACX81343

SEQ ID NO: 28163 - RNA, 1611 nt, Artificial Sequence
  derived and/or modified sequence opt5 from capsid_protein__Norovirus__ACX81345
augaagauggccagcaacgacgcuacccccuccgaugacggcgccgcggggcuggugccugagaucaauucugaagucauggcucucgagccgguugccggagccagccuggcugcccccguggugggccagcaaaacauuaucgauccuuggauuagaaauaacuucguccaggcucccgccggggaauuuacaguguccccuagaaauucucccggagagcuucugcucgaccuggaacuuggcccugagcugaacccguaccucgcgcaccuggcccgcauguauaaugggcaugcuggaggcauggagguucagaucgugcuggccggcaacgcuuucacggccgggaagauucucuuugcggccauucccccuagcuuccccuacgaaaaucuguccccugcucagcuuaccaugucuccccacgucaucguggauguuagacaacugaagccggugcuccugccuaugcccgacaucaaaaacgauuuuaaucauuauaaccagaagaauaacacaaaacuucggcuggucgccaugcucuacaccccucugcgcgcuaauaacagcggagacgaugugugcacagaguccuguagagugcugacccggcccagccccgacuuccaguuuacauuccucgucccuccgaccguugaaucuaagacgaagaacuuuacccugcccgugcuucgcguguccgagaugacaaauagcagauucccugucgugcuggaucagauguauaccucucggaacgagaauaucauuguucaaccccagaacggccgcugcacaaccgacggggaacuccugggaacgacaauccuucaguccgugagcauuuguaauuuuaaaggcaccaugcaggccaagcugaacgaggaaccuagauaccaacuccagcugacaaaucuggaugggucucccaucgacccgaccgacgauaugccugcuccccucggaaccccugacuuccaggccaugcuguauggcgucgcgucccaacggagcuccauugauaacgccacacgcgcucacgacgcccagaucgauacggccggcgacaccuuugcucccaaaaucggacaggugagauucaagucuagcuccaaugauuucgaccuucaugauccuacaaaauuuacccccauugggguuaacguggacgaucagcacccguuccggcaauggagccugccuaauuacggcgggcaccucgcccugaacaaucaucuugcgcccgcugucacaccccuguuuccuggagagcagauccucuucuuucgcucuuacauuccguccgccggcgggcacaccgacggagccauggacugccugcugccccaggaauggguggagcauuucuaucaggaggcugccccuagccaaucugauaucgcucucgucagauuuauuaaccccgacacgggccgggugcuguucgaagccaaacuucacaagcagggcuuucugacaaucgcggccagcggggaucacccuaucguuaugcccaccaauggauacuucagauuugaggcuugggugaacccuuucuauacccucgcccccgucggcacaggguccggacgccggcggauucaguga

SEQ ID NO: 28164 - RNA, 1611 nt, Artificial Sequence; identical to SEQ ID NO: 28161
  derived and/or modified sequence opt5 from capsid_protein__Norovirus__ACX81347

SEQ ID NO: 28165 - RNA, 1611 nt, Artificial Sequence; identical to SEQ ID NO: 28161
  derived and/or modified sequence opt5 from capsid_protein__Norovirus__ACX81349

SEQ ID NO: 28166 - RNA, 1611 nt, Artificial Sequence; identical to SEQ ID NO: 28161
  derived and/or modified sequence opt5 from capsid_protein__Norovirus__ACX81351

SEQ ID NO: 28167 - RNA, 1611 nt, Artificial Sequence
  derived and/or modified sequence opt5 from capsid_protein__Norovirus__ACX81353
augaagauggccagcaacgacgcuacccccuccgaugacggcgccgcggggcuggugccugagaucaauaacgaagucauggcucucgagccgguugccggagccucuauugcugcccccguggugggccagcaaaauaucauugauccuuggaucagaaacaauuucguccaggcucccgccggggaauuuacagugagcccucggaacucccccggagagcugcuucuggaccucgaacugggcccugagcuuaauccguaccuggcgcaccucgcccgcauguauaacgggcaugcuggaggcauggagguucagauugugcuggccggcaaugcuuucacggccgggaaaauccuguuugcggccauucccccuucuuuccccuacgaaaaccucagcccugcucagcugaccaugugcccccacgucaucguggauguuagacaacuugagccggugcugcucccuaugcccgacauccggaaugucuuuuaucauuacaaccagaauaacuccccuaagcugcgccuuguggccaugcuguauacaccccucagagcuaauaacucuggagaugacguguucaccgucagcugucggguucugacacgccccuccccugauuuucaguucaccuuucuggugccgcccacaguggaaagcaaaaccaagaacuucacgcucccuguccugagagugucugagaugaccaauucccgguuucccguugugcuugaccagauguacacaagccgcaacgagaauauuaucguccaaccucagaacggcagaugcaccacagauggggaacugcucggaaccacgauucugcagucuguguccaucuguaauuucaaaggcacaaugcaggccaaacuuaacgaggaaccccgguaucaacugcagcucaccaaucuggacgggagcccgauugauccuacagacgacaugcccgccccucugggaacccccgauuuucaggcuaugcucuacggcguugcgucucaacgcuccagcagagacaacgccacccgggcucacgaugcccagaucgacacagccggcgauacguucgcuccuaagaucggacaggugcgcuucaaguccucuagcaaugacuuugaucugcaugaccccaccaaguucacaccgauuggggucaacguggaugaccagcacccuuuuagacaauggucccuucccaauuacggcgggcaccuggcccucaacaaucaucuggcgcccgcugucaccccucuuuucccgggagagcagauccuguuuuuccggagcuauauucccucugccggcgggcacacagauggagccauggacugccuccugccucaggaauggguggagcauuuuuaccaggaggcugcccccucccaaagcgacaucgcucugguuagauucauuaacccugauaccggccgcgugcucuuugaagccaaacugcacaagcagggcuuccuuacgaucgcggccucuggggaccaccccaucgucaugccuacaaauggauauuuucgguucgaggcuugggugaaccccuuuuacacccuggccccgguuggcaccgggagcggaagacgccggauucaguga

SEQ ID NO: 28168 - RNA, 1611 nt, Artificial Sequence; identical to SEQ ID NO: 28161
  derived and/or modified sequence opt5 from capsid_protein__Norovirus__ACX81355

SEQ ID NO: 28169 - RNA, 1623 nt, Artificial Sequence
  derived and/or modified sequence opt5 from capsid_protein__Norovirus__ACX85806
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucgucguggacgugagacaacucgagccuguccugauuccccugccugauguucggaacaauuuuuaucacuacaaccaguccaaugaccccaccaucaagcucauugcuaugcuguauacaccccuucgcgccaacaacgcuggagaugacguguucaccgugagcugcagaguccugacacggccuucuccggauuuugacuucaucuuucucgugcccccuaccguugaaucccgcacgaaacccuucagcgugccuauucugaccgucgaggaaaugacaaauucuagauuucccaucccgcuugagaagcuguucaccggcccuuccagcgccuucgugguucagccccagaacgggcgguguacaaccgauggagugcuccugggcacgacacaacugucuccugucaauauuugcaccuuucgcgggaacgugacacauaucgccggaacccaggaguacaccaugaaucucgcuucccagaacuggaauaacuaugaccccacagaagagaucccugcgccccugggcacgccggauuucgucggcaaaauucagggggugcuuacccaaacaaccagacgggacggaagcacacgcggccacaaggccaccguuuccacggggucugugcauuuuacaccuaagcugggaagaauccaguucagcaccgacaccuccaaugauuuugaaacaggccagaacacccgguucacacccgucggggugguucaagacggaagcacgacccaccagaaugagccccagcagugggugcucccuaacuacucuggccgcgauucccacaauguccaucuggcuccggccguggcccccagcuuuccuggcgaacaacuucuguucuuuagaucuacaaugcccggguguagcggauacccuaacaugaaucucgacugccugcugccccaggagugggugcagcacuucuaucaggaggcugccccugcgcaauccgauguugcucuccugcgguuugucaaccccgacaccggcagagugcuuuucgaauguaaacugcauaagucuggguacgugacagucgcccacaccggacagcacgaucucgugauuccgccuaacggcuauuuucgcuucgacagcuggguuaaucaguucuacacgcuggcccccauggggaacggcaccggacggagacgcgcucuuuga

SEQ ID NO: 28170 - RNA, 1647 nt, Artificial Sequence
  derived and/or modified sequence opt5 from capsid_protein__Norovirus__ACX85807
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcgcugacggccggaaaaaucaucuuugcugccauucccccuaauuuccccaucgauaaccugucugcugcccagauuaccaugugcccucaugugaucgucgacgugcgccaacucgaacccguuaaucugccgaugccugaugugagaaacaacuuuuuccacuauaaucagggcagcgacucccggcuucgccugauugccaugcucuacacaccccugagagcuaacaauucuggggaugacgucuuuaccgugagcugucgggugcuuacacgcccuucccccgauuucagcuuuaacuuccugguucccccuaccgucgagucuaagacaaaaccguuuucccuccccauccugaccauuagcgaaaugucuaauuccagauucccugugcccaucgacagccugcauacgucuccuaccgagaacaucgugguccagugccagaauggacgggugacacucgauggcgagcugauggggaccacacaacuucugcccucccagauuugugcguuucgcggaguucucaccagaagcacgucccgggccucugaccaggcugauacagccaccccgcgccuguucaacuauuacuggcacauccagcuugacaaucugaacggcacaccuuaugaccccgccgaagauauuccuggcccccucgggaccccugacuucagaggaaagguguuuggcgucgcuagccaacggaaucccgaugccaccacacgcgcgcaugaggcuaaaaucgacacgaccuccgggagauucacaccgaagcugggaagccuggaaauuucuaccgaguccgaugacuuugaucagaacaagccuacacgguucacccccgugggcaucgggguugaccacgaagaggauuuucagcaauggacgcuccccgacuacgccggacaguucacacacaauaugaaccuggccccugcuguggccccgaauuuucccggcgagcagcuucuguucuuuagaagccagcucccuucuagcggcgggcgcuccaacggaauccuggauugccuugucccccaagaaugggugcagcauuucuaccaggagucugcuccuagccagacccaagucgcccuggugcgguauauuaaucccgacaccggcagaguucucuuugaagcgaaacugcacaagcugggguucaugacaaucgccaaaaacggagacuccccuauuaccgugcccccgaacggcuacuuucgcuucgagagcugggucaauccuuucuauacacucgcucccauggggacgggcaacggacggagacgcauccaguga

SEQ ID NO: 28171 - RNA, 1623 nt, Artificial Sequence
  derived and/or modified sequence opt5 from capsid_protein__Norovirus__ACX85809
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagcccccgcaauuccccuggagagauccuucuggaucucgaacugggcccggagcuuaaccccuaccuggcccaccucgcgcggauguauaaugggcaugccggaggcauggagguucagauugugcuggcuggcaacgccuucacggcugggaaaaucaucuuugccgcgauuccucccggauucccuuacgaaaaucugucucccagccagaucaccaugugcccgcacgucauuaucgacgugagacaacucgagccuguucugcuucccaugccugauauucggaacaacuuuuuccauuauaaucagggcaaugaccccaagcugcgccucaucgccaugcuguacacaccccuuagagcuaacaacuccggggaugacguguuuaccgucucuuggcggggacugacaaaaaccagcccugauuucgaauuuacauuccucgugccgcccaccguggaguccaagacgaaacaguuuacccugccuauucugaagaucagcgagaugacaaauucucgcuuccccgucccuguugaaaugauguauaccgccagaaacgagaaucagguggugcaaccccagaacggccgggucacacucgacggggaacugcuuggaaccacgccgcugcucgcugugaauaucuguaaguuuaaaggcgagguuauugccaagaacggcgaugugcgcuccuacagaauggacauggaaaucacaaauaccgaugggacaccuauugaccccaccgaggacaccccuggacccaucggcagcccugauuuccaggggauucuguucggagucgccucucagcggaacaaaaaugagcaaaaccccgcuacacgcgcgcacgaagccaauaucaacacgggcggggaccaguaugcuccgaaacuugcccaggugaaguuuuucuccgagagccaagauuuugaaguucaucagccuaccguguucacacccgucggaguggccggcgacaccucucaccccuuuagacaguggguccugccucgguacggcgggcaccucacaaauaacacccaucuggcuccggccguggcgccccuguucccuggagagcagauccucuuuuuccgcucccaaauucccagcuccggcgggcacgaacugggauacauggauugccuuguuccucaggagugggugcagcauuuuuaucaggaggcugccacggcccaaucugaagucgcucugaucagauucauuaaucccgacacaggccgggugcucuuugaggccaagcugcacaagcagggguucaucaccguugcucacaccggcgauaacccuauugugaugcccccgaacggauacuuuagauucgaagccugggucaaucaguucuauagccuugcgccugugggcacagggaacggacgccggagaauccaguga

SEQ ID NO: 28172 - RNA, 1623 nt, Artificial Sequence
  derived and/or modified sequence opt5 from capsid_protein__Norovirus__ACX85810
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagcccccgcaauuccccuggagagauccuucuggaucucgaacugggcccggagcuuaaccccuaccuggcccaccucgcgcggauguauaaugggcaugccggaggcauggagguucagauugugcuggcuggcaacgccuucacggcugggaaaaucaucuuugccgcgauuccucccggauucccuuacgaaaaucugucucccagccagaucaccaugugcccgcacgucauuaucgacgugagacaacucgagccuguucugcuucccaugccugauauucggaacaacuuuuuccauuauaaucagggcaaugaccccaagcugcgccucaucgccaugcuguacacaccccuuagagcuaacaacuccggggaugacguguuuaccgucucuugucgggugcugacaaaaccuagcccggauuucgaauuuaccuuccucgugcccccuacagucgaguccaagaccaaacaguuuacgcugcccauucugaagaucagcgagaugaccaauucucgcuucccuguucccguggaaaugauguauacagccagaaacgagaaucaggugguccaaccgcagaacggacgggugacccucgacggcgaacugcuugggacaaccccucugcucgcuguuaauaucugcaaguuuaaaggagaggugauugccaagaacggcgauguccgcuccuacagaauggacauggaaaucacgaauacagauggcacccccauugacccuacagaggacacccccgggccuaucggaagccccgauuuccagggcauucuguucgggguggccucucagcggaacaaaaaugagcaaaacccggcuacccgcgcgcacgaagccaauaucaacacaggaggcgaccaguaugcuccuaaacuugcccagguuaaguuuuucuccgagagccaagauuuugaagugcaucagcccacggucuucacccccgugggggucgccggagacacaucucacccuuuuagacagugggugcugccgcgguacggcggccaccucaccaauaacacacaucuggcucccgccguugcgccucuguuccccggggagcagauccucuuuuuccgcucccaaauuccuagcuccggaggccacgaacugggguacauggauugucuugugccccaggaguggguccagcauuuuuaucaggaggcugccgccgcucaaucugaaguggcccugaucagauucauuaauccugacaccggacggguucucuuugaggcuaagcugcacaagcagggcuucaucacgguggcccacacaggggauaaccccauugucaugccgccuaacggcuacuuuagauucgaagcgugggugaaucaguucuauagccuugcccccgugggaaccggcaacgggcgccggagaauccaguga

SEQ ID NO: 28173 - RNA, 1569 nt, Artificial Sequence
  derived and/or modified sequence opt5 from capsid_protein__Norovirus__ACY41155
augaagaugaccgacagagauacaacggaccccgccccugcucugggccaggugcucccgcccgaggucgaagccagcguuccuguggagcccaccgcgggggcuccuguggccgccgcuacagccggacaagucaaccccaucgauccuuggauuuucgcuaauuuugugcaggccccgcagggcgaauuuaccaucucccccaacaauaacccuggggagauucuguuugaacuugagcugggacccgagcucaauccuuaccuggcgcaccuucggcgcauguauaacggcuggacagggucuaugagaguucgggugcugcucgccggaaaugcuuucagcgccggcaaagucgugguuuucugcgugcccccgggcuucgacgcuuccuaccugaccccuucucaggccacacaauuuccccauguccugaucgaugugcgcgcgccugaacccguggagaugccccucgaagacgucagaaacauucuguuccaccaggggccugauagccggaugcgccuuaugggaaugcuguauaccccgcucagagccaauuccggcgcugaccccuuuguugugacggggcgggugcugaccuguccuucucccaacuucagcuuuuucuuucuugucccucccacaguggaggagcgcgaaguuccguucacccugccuaaucuccccgugaacaaucugucccauagcagagucauggagccuaucgcccagaugaugucuucccggaaccugcccgcuagcgugcaguuccaaaauggacgcugcacacucgccggcgaucugcuugggaccacgccuucuucccccgccgaccugggaacauuuguuggccucaucgcugaaccgggcagcagaguggucgagcuguuccagccuaaccaggaagauuuucacgcggggucugcccccgcuccccuuggauucccugacuuuuccgauuguagccugaccuucguggucgccuccucuacaaccgugggcgagcggaccguuaacagccgcuccccgcagaauuuuacacccgcccucgggcaugugacgcuggacgaggaagcuccugccgaccuguucagagcgcggcucagaaaccugugggaucccaccgagcacagcuuuuggcgcauuccugacuaccgggcugauguccuuggaucugaguucgcccccuccgugagcgccccuggcguuggggaaacacugcucuuuuucaugugcaaugugcccagacugaacggagcuaauccgaacccuugucccugccuucugccucaagaauggaucacccacuuugucucugagcgcgccgcucuccagggcgacguggcccugcugaauuaugugaaccccaauacaggccggguucucuucgaguguaagcuguacgcgaacggguuccuuaccgucaaucugggagccagcgaucaggcuacgcucccgguggacggcauuuuuaaauucguguccugggucucuuuuuauuaccaacugagaccuguggggaacgccagcguuggacgccggcugcccagacuuaauggcuucuga

SEQ ID NO: 28174 - RNA, 1623 nt, Artificial Sequence; identical to SEQ ID NO: 27508
  derived and/or modified sequence opt5 from capsid_protein__Norovirus__ADA77528

SEQ ID NO: 28175 - RNA, 1620 nt, Artificial Sequence
  derived and/or modified sequence opt5 from capsid_protein__Norovirus__ADB22512
augaagauggccagcaacgacgcugcccccuccaaugauggcgcgaccgggcuggugccugaggucaacacagaaacgcucccgcuggagcccguugcuggagccgccaucgcugccccugugaccggccagaauaacauuaucgaccccuggauuagaucuaauuucgugcaagcuccuaacggggaauuuacagucagcccccgcaauuccccuggagagauccuuaugaaccuggaacucggcccggaucugaaucccuaccuugcccaccugucucggauguauaacggguacgcgggaggcguggagguucaggugcuccuggccggcaaugcuuucaccgccgggaaaauucuguuugcugccgucccucccaacuucccuguggacaugcucagccccgcgcagaucacaaugcugccgcaucuuaucguugaugugagaacccuggagccuauuaugaucccccucccugacguccggaauguguuuuaucacuucaacaaucagcccgcuccccgcaugagacugguggccaugcuuuacacaccucugcgguccaacggaucuggcgaugacgucuuuaccguuagcugccgcgugcucacgagaccgacccccgauuucgaauuuacauaucuggugccucccuccgucgagagcaagaccaaaccuuucacacugcccauucucaccaucggggaacugacgaacucucgguuuccggccccuauugaccaacuuuacacaucccccaaugcugaugugguugugcagccucagaacggacgcuguacccuggacggcgagcuccaggggacaacccaacugcuuaccacagccaucugcagcuauagaggaaugacgucuaaucccaccuccgauuacugggacggccaucugcuccaccugguccauccuaacggcgccacauacgaccccaccgaggaugugccggcuccuuucgggacacaggacuuucggggcauucuguauggaaugcucacccagaauccccgcacgagcggggaugaagcggccaacucucacggaguuuacaucuccagcacauccgagaaguucacccccaaacugggcaccaucgggcuucaccaggugcaaggagaccauucucagcagcaacagagcaaguucacaccugucggcauugcugugaauggcaacaccccguuuagacagugggaacugcccaauuauuccggggcccucacacugaacacgaaucuugccccugcugucggacccaacuucccuggcgagcagauccuguuuuuccggagcaaugugcccucuguucaagggggacagccuauugaaaucgauugucucauuccccaggagugggugucccacuuuuaccaggagagcgccccgucucaaagcgacgucgcgcuggugcgcuauguuaacccugauaccggcagaacaaucuucgaagcuaagcugcaucggcagggguuuaucaccauugccgccacaggcuccaaucccguggucgugccucccaacggauacuucagauuugacucuugggugaaccaguucuaugcucucgccccgaugggcaccgggaauggacgccggagaauccaguga

SEQ ID NO: 28176 - RNA, 1623 nt, Artificial Sequence
  derived and/or modified sequence opt5 from capsid_protein__Norovirus__ADC91993
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuagcgacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguucagaaugugcaccuugccccggcugucgcccccaccuuuccuggagagcagcuccuguucuuucggucuacaaugcccggcuguuccggguauccuaacauggaucuggacugccugcucccccaggagugggugcaacauuucuaccaggaagcggcuccugcccagagcgauguggcccugcuucgcuuuguuaaucccgacaccggaagaguccuguucgaguguaaacuccacaagucuggcuaugugacaguggcucauaccgggcagcacgaucuggucaucccgccuaacggcuacuuucgguucgacagcugggugaaccaauucuauacgcuugcccccaugggaaauggcaccgggagacgccgggcucuguga

SEQ ID NO: 28177 - RNA, 1623 nt, Artificial Sequence
  derived and/or modified sequence opt5 from capsid_protein__Norovirus__ADC91994
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucaccggcagcagaaacuacacaaugaaucucgccacgcagaacuggaacucuuaugaucccaccgaggaaauuccugcuccccugggcacaccggacuucguggggaaaauccagggaguccuuacccagacaacccgggcggacggcuccacgcgcgggcacaaggccacaguguacaccggaagcgcugauuuuuccccuaagcugggcagaguucaauucgccaccgacacagauaaugacuuugaugccaaucagaacaccaaauucacacccgugggggucauucaggacggagauacggcucaucggaaugagccccaacagugggugcucccuucuuacagcggccgcaacucccacaauguucaccuggccccggcgguggcucccaccuuuccuggcgaacagcuucuguucuuuagaagcacaaugcccggguguucuggauauccuaacauggaccucgauugccugcugccccaggaguggguccaauacuucuaucaggaagccgccccugcucaguccgacguggcccuccugcgguuugugaaucccgauaccggcagaguucuuuucgaguguaagcugcauaaaagcggguacgucacaguggcucacaccggacagcaugaccucgugaucccgccuaacggcuauuuucgcuucgacucuugggucaaccaauucuacacgcuggcccccauggggaauggcaccggacggagacgcgcgcuuuga

SEQ ID NO: 28178 - RNA, 1611 nt, Artificial Sequence; identical to SEQ ID NO: 28161
  derived and/or modified sequence opt5 from capsid_protein__Norovirus__ADE28701

SEQ ID NO: 28179 - RNA, 1644 nt, Artificial Sequence
  derived and/or modified sequence opt5 from capsid_protein__Norovirus__ADE28721
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuaucccgacccgaaugaaggcauugugguccaaccucagaacgggagaugcacacuggauggaacccuucagggcacaacccagcuggugcccacgcaaaucugugccuuucgggggacacucauuggacagaccucccgcagcucugacuccacagauagcgcuccuagacggcgcgaccacccccugcauguucagcuuaagaaucuggauggcacccaauacgacccuaccgacgaggugcccgcgguccucggcgccaucgauuucaaagggacaguguucggagucgcuucucagagagacguguccggccagcagguuggggccacgcgggcccacgaagugcacaucaacaccacagauccgagauauaccccuaagcugggaagcauucugaugcauuccgagucugacgauuuugucacaggccaacccgugcgcuucacccccaucgggaugggagacaaugauuggcaccagugggagcucccugacuacagcggccaucugacgcuuaacaugucccuggcuccggccguugcgcccgcuuuuccuggcgaacggauucucuucuuuagaagcaucgugcccucugccgggggauacggcuccggguauauugauugccugaucccucaggaguggguccagcacuucuaccaagaagccgcucccagccagucugccguggcucuuauccgcuaugugaauccugacacaggacggaacauuuuugaggccaagcugcacagagaaggcuucaucaccguugcgaauagcgggaacaaucccauugucgugccgccuaacggcuacuuucgcuucgaggccugggugaaucaguuuuauacccucacacccaugggaaccggccaggggcggagacgcaaccaauga

SEQ ID NO: 28180 - RNA, 1644 nt, Artificial Sequence
  derived and/or modified sequence opt5 from capsid_protein__Norovirus__ADE28722
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauauguuuuauacagaccccaaugaaggcauugugguccacccgcaaaacgggagaugcacccucgauggaacacugcagggcaccacgcagcuugugccuacacagaucugugccuuccgggggacccugauuggacaaacaucccgcagcucugacuccaccgauagcgcucccagacggcgcgaccauccucuccacguucagcugaagaaucuugauggcacccaguacgaccccacagacgaggugccugcgguccugggcgccaucgauuucaaagggacgguguuuggagucgcuucucaaagagacguguccggccagcagguuggggccacccgggcccacgaagugcauaucaacacaaccgaucccagauauacaccgaagcucggaagcauucugaugcacuccgagucugacgauuucgucaccggccagccugugcgcuuuacgcccaucgggaugggagacaaugauuggcaucaaugggagcugcccgacuacagcggccaccucacacugaacaugaaucuugcuccugccguugcgccggcuuuccccggcgaacggauucuguuuuucagauccaucgugccuagcgccgggggauacggcucuggguauauugauugccucaucccccaggaguggguccagcacuuuuaccaggaagccgcuccuucccaaagcgccguggcucugauccgcuaugugaaccccgacaccggacggaauauuuucgaggccaaacuucauagagaaggcuuuaucaccguugcgaacucugggaauaacccuauugucgugcccccgaauggcuacuuccgcuuugaggccugggugaaccaguucuauacacugaccccuaugggaacaggccaggggcggagacgcaaucaguga

SEQ ID NO: 28181 - RNA, 1644 nt, Artificial Sequence
  derived and/or modified sequence opt5 from capsid_protein__Norovirus__ADE28723
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagaucucccgcagcucugacuccacagauagcgcucccagacggcgcgaccacccucugcauguucagcuuaagaaucuggauggcacccaauacgaccccaccgacgaggugccugcgguccucggcgccaucgauuucaaagggacaguguucggagucgcuucucagagagacguguccggccagcagguuggggccacgcgggcccacgaagugcacauuaacaccacagaucccagauauaccccgaagcugggaagcauccugaugcauuccgagucugacgauuuugucacaggccaaccugugcgcuucacccccauugggaugggagacaaugauuggcaccagugggagcuccccgacuacagcggccaucugacgcuuaacaugaaucuggcuccugccguugcgccggcuuuucccggcgaacggauccucuucuuuagauccauugugccuagcgccgggggauacggcucuggguauaucgauugccugaucccccaggaguggguccagcacuucuaccaagaagccgcuccuucccagagcgccguggcucuuauucgcuaugugaaccccgacacaggacggaauaucuuugaggccaagcugcacagagaaggcuucauuaccguugcgaacucugggaauaacccuaucgucgugcccccgaauggcuacuuucgcuucgaggccugggugaaccaguuuuauacccucacaccuaugggaaccggccaggggcggagacgcaaucaauga

SEQ ID NO: 28182 - RNA, 1644 nt, Artificial Sequence
  derived and/or modified sequence opt5 from capsid_protein__Norovirus__ADE28724
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaggauguguuuaccgugagcuguagaguccugacacggcccgcucccgacuucgaguuuaccuuccuugugccuccgacaguugaauccaagaccaaacccuuuacgcugccuauucucacccugggagagcugagcaacucucgcuuccccgccccuaucgauaugcucuauacagaccccaaugaaggcauugugguccaaccgcagaacgggagaugcacccuggauggaacacuucagggcaccacgcagcuggugccuacacaaaucugugccuuucgggggacccucauuggacagacaucccgcagcucugacuccaccgauagcgcucccagacggcgcgaccacccucugcauguucagcuuaagaaucuggauggcacccaauacgaccccacagacgaggugccugcgguccucggcgccaucgauuucaaagggacgguguucggagucgcuucucagagagacguguccggccagcagguuggggccacccgggcccacgaagugcacaucaacacaaccgaucccagauauacaccgaagcugggaagcauucugaugcauuccgagucugacgauuuugucaccggccaaccugugcgcuucacgcccaucgggaugggagacaaugauuggcaccagugggagcuccccgacuacagcggccaucugacacuuaacaugaaucuggcuccugccguugcgccggcuuuucccggcgaacggauucucuucuuuagauccaucgugccuagcgccgggggauacggcucugauuauauugacugccugaucccccaggaguggguccagcacuucuaccaagaagccgcuccuucccagagcgccguggcucuuauccgcuaugugaaccccgauaccgggcggaauauuuuugaggccaagcugcacagagaaggauucaucaccguugcgaacucuggcaauaacccuauugucgugcccccgaauggguacuuucgcuucgaggccugggugaaccaguuuuauacacucgcuccuaugggcaccggacagggccggagacgcaaucaauga

SEQ ID NO: 28183 - RNA, 1647 nt, Artificial Sequence
  derived and/or modified sequence opt5 from capsid_protein__Norovirus__ADK23787
augaagauggccagcaacgacgcuacccccuccaaugauggcgccgcggggcuggugccugagaucucuaacgaagcuauggcccucgacccggucgccggagcugccauugcugcgccccugacaggccagcaaaauaucauugauccuuggaucaugaacaauuucguucaggcccccgggggagaguuuacggugagcccuagaaacucccccggcgaagugcuucugaaucucgagcuggggccugaaauuaacccguaccuugcccaccuggcucggauguauaauggauacgccggcggcuucgagguccaggugguucucgcugggaacgccuuuaccgcgggaaaaaucaucuucgccgcuauucccccuaauuuucccaucgacaaccugucugccgcucagauuacaaugugcccucaugugaucgucgaugugcgccaacuggagcccguuaaucucccgaugccugacgugagaaacaauuucuuucacuauaaccagggcagcgauucccggcugcgccuugucgccaugcuguacacaccccucagagccaacaauucuggggacgauguguucaccgugagcugucggguccugacccgcccuucccccgacuuuagcuucaacuuucuuguucccccuacaguggaaucuaagaccaaaccguucacgcugcccauucucaccaucuccgagaugagcaauucuagauuuccugugcccauugauucccugcauacaagcccuaccgaaaacgucgugguucagugccagaauggacgggugacacuggacggcgagcucauggggaccacgcaacugcuucccucucagaucugugcuuuccgcggaguccugacaagauccaccagccgggcguccgaucaggccgacacagcuaccccgcgccucuucaacuauuacuggcacauccagcuggacaaucuuaacggcaccccuuaugaucccgccgaggacauuccuggcccccuggggacaccugauuuuagaggaaagguguucggcguugccucucaacggaaucccgacagcacgacccgcgcucaugaagccaaaaucgauacaaccgcggggagauuuacaccgaagcucggaucccuggagauuagcaccgaaucuggcgacuucgaucagaaccagccuacgcgguuuacacccguggggaucggagucgaccacgaggcugauuuccaacaguggucccugcccgacuacagcggccaguuuacccacaauaugaaccucgccccugccguggcuccgaauuuccccggcgaacagcugcuguuuuucagaucucaacuuccuagcuccgggggacgcucuaacggcauucucgauugccuggucccccaggagugggugcagcauuuuuaccaggagagcgccccugcucaaacccagguugcccuugugcgguaugucaaucccgacacagggagagugcuguucgaagcgaagcuccacaaacugggauuuaugaccaucgccaagaacggcgacuccccuaucacaguucccccgaacggguacuuccgcuucgagagcugggugaauccuuuuuauacgcuggcucccaugggcaccggaaacggccggagacgcauucaguga

SEQ ID NO: 28184 - RNA, 1623 nt, Artificial Sequence
  derived and/or modified sequence opt5 from capsid_protein__Norovirus__ADM52743
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccgggccuagcucugccuucgucgugcagccccagaauggacgguguacaaccgauggcguucuccuggggacgacacaacuguccccugugaacaucugcaccuuucgcggagacgucacacauaucaccggcagcagaaauuacaccaugaaccucgccacacagaauuggaacucuuaugaucccacggaggaaauuccugcuccccugggcaccccggacuucguggggaaaauccagggaguccuuacacagaccacacgggcggacggcuccacccgcgggcacaaggccacgguguacacaggaagcgcugauuuugccccuaagcugggcagaguucaauucgccaccgacaccgauaaugacuuugaugcuaaccagaauacaaaauucacccccgugggggucauucaggacggaaacacagcccaucggaaugagccccaacagugggugcucccuuccuacucuggccgcaacagccacaauguucaccuggcgccggcuguggcccccacguuuccuggcgaacagcuucuguucuuuagauccaccaugcccggguguagcggauauccuaacauggaucucgacugccugcugccccaggaguggguccaauacuucuaucaggaagccgcuccugcccagucugauguggcucuccugcgguuugugaaccccgacacaggcagaguucuuuucgaguguaagcugcauaaauccggguacgucaccguggcccacacaggacagcaugaucucgugaucccgccuaauggcuauuuucgcuucgacagcugggucaaccaauucuacacccuggcgcccauggggaauggcacgggacggagacgcgcccuuuga

SEQ ID NO: 28185 - RNA, 1623 nt, Artificial Sequence
  derived and/or modified sequence opt5 from capsid_protein__Norovirus__ADR57234
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagcucaaugaccccaccauuaagcugaucgcuaugcuuuauacaccccugcgcgccaacaacgcuggcgaugacguuuucaccgugagcugcagagugcucacacggccuuccccggauuuugacuucauuuuucuggugcccccuaccgucgaaagccgcacgaaacccuucucuguuccuauccuuaccguggaggaaaugacaaauuccagauuucccauuccgcuggagaagcuguucaccgggccuagcucugccuucgucgugcagccccagaacggacgguguacaaccgauggcguucugcuggggacgacacaacucuccccugugaauaucugcaccuuucgcggagacgucacacauaucaccggcagccacaacuacaccaugaaucuggccucucagaacuggaacuccuaugaucccacagaggaaauuccugcuccccuuggcacgccggacuucguggggaaaauccagggaguccugacccagacaaccagagcggacggcagcacacgggggcaucgcgccaccguguacacgggauccgcugaguuugccccuaagcucggcagaguucaauucgccacagauaccgaaaaugacuuugauaccaaucagaacacaaaguucacccccgugggggucauucaggacggaaauacaacgcaccggaacgagccccaacagugggugcugccuucuuacagcggccgcaauucccacaacguucaucuugcuccggccguggcgcccaccuuuccuggcgaacagcuccucuucuuuagaagcacaaugcccggguguucuggauauccuaaucuggaucuggacugccuccugccccaggaguggguccaacacuucuaccaggaggcugccccugcccaguccgauguggcccuucugcgguuugugaaccccgacaccggcagaguucucuucgaauguaaacugcauaagagcggguaugucacaguggcucacaccggacagcacgaucuugugaucccgccuaacggcuacuuucgcuucgacucuugggucaaucaauucuauacgcuggcucccauggggaacggcaccggacggagacgcgcccucuga

SEQ ID NO: 28186 - RNA, 1626 nt, Artificial Sequence
  derived and/or modified sequence opt5 from capsid_protein__Norovirus__AEA07712
augagaaugagcgacggcgccgcucccaaggccuccgggucugaggcgagcggacaggaucuggugccuuccgcugucgaacaagccguuccgauccagcccguggugggcgccacccucgcugccccugcugccgggcagauuaaccagaucgaccccuggauuuuccaaaauuuuguccagugcccucugggagaguucucuaucagcccccggaacacaccuggcgaaauucuuuuugaucuggcgcucgggccgggacugaaucccuaccuugcccaccuguccgcuauguauacgggcugggugggcaacauggagguucagcucgugcuggccgggaaugcuuucaccgccggaaaagucgugguugcgcuggugccucccuacuuuccuaagggcucuaucacaaccgcccagaucacauguuucccccaugucaugugcgacgugcgcacccucgaaccgauucaacugccucuucuggaugugagacggguccucuggcacgcuacacaggaccaggaggagagcaugcgccugguuuguaugcuuuauacgccccugagaaccaacuccccuggggaugagagcuuuguggugucuggacggcuccuguccaaacccgccgcugacuucaauuuugucuaccugacacccccuaucgaacgcaccauuuauagaaugguggaucucccgguucugcagccccggcuuugcacccaugcccgcuggccugcccccguguacggccugcucgucgacccuagccugcccucuaacccgcaauggcagaaugggagagugcacguugauggaacacuucugggcaccacgccuguguccggcagcugggucucuuguuucgcugcggaagccgcuuaugaguuucaguccgggaucggagagguggccacauucacccucauugaacaagacggcagcgccuaccugcccggggaucgggcugccccucugggauaccccgacuuuuccggccagcucgagaucgaaguccagacagagaccaccaaggcgggggacaaacugaaggugacaacguucgaaauggcucuuggaccuaccacaaacguugaucaggcccccuaucaaggccgcguguucgccucuuuuaccgcuagcgccucccuggaccucgucgauggcagagugcgggcuguuccgcgcagcauuuucggguuucaggacguggucccugaguacaaugauggacugcuugugccccuggcgcccccuaucggcccguuccuccccggggaggugcugcugagauuucggacauauaugagacagaucgacucuuccgaugccgccgcugaagccauugacugcgcucucccucaggaguucguuagcugguuugccucuaacggauucaccguccaaagcgaugcgcugcuucugcgcuaccggaauacgcucacaggccagcugcuguuugaauguaaacuuuauuccgacggguacaucgcccucucuuauagcggcuccggaccccugaccuucccuaccgauggcuuuuucgagguggugagcuggguccccagacuguaccagcucgcuucuguggggucccuggccacaggacgcacccuuaagcaguga

SEQ ID NO: 28187 - RNA, 1623 nt, Artificial Sequence
  derived and/or modified sequence opt5 from capsid_protein__Norovirus__AEK05311
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuugcggugagcccucggaacgcccccggagagauucugugguccgcuccucuuggcccggaucugaaucccuaccucucucaccuggcccgcauguauaacggguacgcuggaggcuucgaaguccaggugauccuugccggcaaugcguuuaccgccgggaaaauuaucuucgcugccguuccucccaacuuuccuacagagggacugagccccucccaggugacgauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugccggcgaagauguuuucaccguguccugcagagugcugacacggcccagcccugacuuugauuucauuuuucucgucccgcccaccguggagucucgcacaaaaccuuucaccguucccauccugacgguggaagagaugaccaacuccagauuuccuauuccccuugagaagcuguucacagggccgagcggagcuuucgucgugcagccucagaauggccgguguaccacagacgggguucuccugggaaccacgcaacugucucccgugaacaucugcacauuucgcggcgaugucacccauaucgcgggcuccagaaauuacacaaugaaccucgccagccugaauuggaacaauuaugacccuaccgaagagauucccgcuccucuugggacccccgauuucgugggaaaaauccagggcguccugacacagacgaccaagggggacggaucuacacggggccacaaggccaccguguacacaggguccgccccguuuaccccuaaacucggaagcguucaguucuccacggacacagaaaacgauuuugagacccaucaaaauaccaaguucgcucccgugggcgucauucaggacggcucuacaacccaccgcaacgaaccccagcaaugggugcugccuagcuacuccgggggaaauguucacaacgugcaucuugccccggcggucgcucccacauuuccuggcgagcagcuccuguucuuuagaagcacgaugcccggguguucuggauauccuaauauggaucuggacugccugcucccccaggagugggugcagcacuucuaccaagaagccgccccugcucaguccgauguggcccugcuucgguuuguuaaccccgacaccggccgcguccuguucgaguguaaacuccauaagagcggguaugugacaguggcucacaccggccagcacgaucuggucaucccgccuaacggauacuuuagauucgacucuugggugaaucaguucuauacacuugcccccaugggcaacgggaccggacggagacgcgcgcuguga

SEQ ID NO: 28188 - RNA, 1608 nt, Artificial Sequence
  derived and/or modified sequence opt5 from capsid_protein__Norovirus__AEP16505
augaagauggccagcuccgacgcugcccccucuaacgauggcgcggcugggcuggugccugaggucaauaacgaaaccauggcccucgagccgguugccggagcuagcaucgccgcuccccugacaggccagaauaacgugauugacccuuggaucagaaugaauuucgugcaagcccccaacggggaauuuacggucuccccucgcaauucucccggagaggugcuucugaaccucgaacugggcccugagcuuaauccguuccuggcgcaccucagccggauguacaacggguaugccggaggcguugaggugcagguccugcuggcuggcaaugccuuuaccgcugggaaacucguguucgccgcgauucccccucauuuuccccuggaaaaccuuuccccuggacagaucacaauguucccccacguuauuaucgaugugagaacccuggagccgguccuccugccucuucccgacgugcggaauaacuuuuuccauuacaaucagcaaccugaaccccgcaugagacugguggccaugcucuauacaccccugcggucuaacggcagcggggaugacgucuuuaccguuuccugccgcgugcugacaagaccuagcccggauuucgacuuuaacuaccucgugcccccuaccgucgagucuaagacgaaacccuucacccugccuauccuuacaauuggagagcuguccaauagccgguuucccgugccgaucgaugaacucuauaccucuccuaacgagggcguugugguccagccccagaaugggcgcuccacacuggacggagaacuucugggcaccacgcagcucgugccuagcaacauuugugcucugagaggccggaucaaugcccaaguucccgaugaccaccaucaguggaaccuucaggugacaaaugcuaacgggaccucuuucgauccuacagaggacguccccgccccgcucggaaccccugacuuccuggccaauauuuacggcgugaccucccagcgcaaccccgauaauacaugcagagcucacgacgggguccuugcgacguggagccccaaguuuaccccuaaacugggauccgugguucucggcacaugggaagagucugaucuggaccuuaaccaaccgacccgguucacacccguggggcuguaugauaccaaucacuuugaccaguggauccucccuaacuacagcggacgccugacgcugaauaugaaccucgcccccuccgucgcuccucuguuccccggcgagcagauucuguuuuucagaagccauaucccucugaagggcgggacaucuaacggagccaucgauugucuccugccccaagaauggauucagcacuuuuaccaggaguccgccccgagcccuaccgacguggcucugauccgguaucccaauccugauaccggcagaguucuuuucgaagccaagcuccugcgccccggguuuauuacaguggcgaacuucggauuuaaaccgaucgucgugccucccaagggcuacuuccgguuugacucuugggugaaucaguucuauagccuggcuccuauggggaccggcaacggaagacgccggguucaauga

SEQ ID NO: 28189 - RNA, 1632 nt, Artificial Sequence
  derived and/or modified sequence opt5 from capsid_protein__Norovirus__AEY77318
augaugauggccagcaaggacgcucccaccaacauggauggcacauccggggccggacagcuggugccugaggucucuacggcggaaccgaucagcauggagcccguugcuggcgccgccaccgcugccgcuacagccgggcaagugaauaugauugacccuuggaucauguccaacuacgugcaggcgccccagggagaguucaccauuucuccuaauaacacacccggcgauauccucuuugaccugcagcuugggccucaccugaauccguuccucagccaucuggcccaaauguauaacggaugggucggcaauaugaaagugagaguucuucuggcuggcaacgccuuuaccgcugggaagauuaucaucuccugcgugcccccuggauucgccgcgcagaaugucucuauugcccaggcuacaauguuuccccacgugaucgccgauguucgggugcucgaaccuauugaagucccccuggaggacgugcgcaacgugcuguuccauaauaacgauagcaccccgacgaugagacucaucuguaugcuguacaccccucuucgggcuuccggcucuagcuccgggacagaccccuuugucauugccggacgcguucugaccugcccuagccccgauuucaauuuucucuuccuggugcccccuaacguggagcagaaaacaaagccguuuucuguccccaaucuuccucugaacgugcucuccaacagcagaguucccucucugaucaaauccaugauggugagccaagaccacggccagaugguccaguuccagaaugggcgggugacccuggauggacaacuccagggcacgacaccuaccuccgccucucagcuguguaagauucgcggcacaguuuaucaugcuaccgggggacaaggccuuaaccugaccgaaaucgacgggacacccuaccacgcguuugagagcccggccccuaucggauuccccgaucucggcgaaugcgacuggcacauuaaugcuuccccugccaacgccuucacggacgggagcaucauucauagaaucgauguggcucaggacucuaccuuugcgccccaccugggaacaauucauuauaccaaugccgauuacaacgcuaaugucggccuuaucuguucccuggaguggcucagcccucccucuggcggggccccgaaggugaacccuugggccaucccccgguauggaagcacacugaccgaggcugcccagcuggcucccccuauuuacccgcccggcuucggggaagccaucgucuuuuucauguccgacuuuccuauugcgaauggaucugauggccucagcgugcccugcacgaucccucaggaguucguuacacacuuugugaacgaacaagcccccacccgcggggaggcugcccugcuucacuacgucgacccugauacccauagaaaucugggcgaguucaaacucuaucccgaaggauuuaugacaugugugccgaacuccagcggcucugggccucagacccugcccauuaauggaguuuucacauuuaucuccugggugagccgguucuaccagcuuaagccugucggcacgaccgggcccgugcgcagacugggaauccggcgcucuuga

SEQ ID NO: 28190 - RNA, 1626 nt, Artificial Sequence
  derived and/or modified sequence opt5 from capsid_protein__Norovirus__AEY83583
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgcccccgacuucaacuuuguguaccucaccccuccgauugagcgcacaaucuauagaauggucgaucugcccgugcuucagccucggcugugcacccaugcccgcuggcccgcuccuguuuacggccuccugguggaccccucucuuccguccaauccucaauggcagaacgggagaguccagguggauggaacacugcucggcaccacgcccguuagcggcucuuggguguccuguuucgcggccgaagcugccuaugaguuucaagccgggacaggagaggucgugaccuucacaaugauugaacaggacggcagcgcuuacgucccuggggaucgggccgcgccccugggauacccugacuuuucuggccagcuggagaucgaagugcagaccgagaccacaaagacgggggacaaacuccgcguuaccacauucgaaaugauucugggacccaccacaaauguggaucaagcuccguaucagggcagagccuacgccucccuuaccgcugccgcuagccuggaccucgucgauggccgggugcgcgccguuccuagauccaucuauucuuuccaggacgagcugcccgaguacaacgauggggugcuugucccccuggcgccuccgcucggacccuuucugccuggcgaagugcugcuccgguucagaacguauaugcgccagcuggacacagccgaugcugccgcucaacccauugacugcgcccuuccucaggaguuuaucagcugguucgcguccaauaacuuuaccgugcagagcgaugcccugcucguucgguacagaaauacccugacagggcagcugcuuuucgaagcuaagcucuauucugagggauacaucgccgucuccuacagcggcucugggccccugaccuuuccuacagacggcuucuuugaaguggugagcugggucccccgccuguuccaacucgcuuccgugggaucucugguuacgggccggacccuuaagcaguga

SEQ ID NO: 28191 - RNA, 1629 nt, Artificial Sequence
  derived and/or modified sequence opt5 from capsid_protein__Norovirus__AFB18010
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagaaccaacuucgugcaagcgcccaauggggaauuuacagucagcccucggaacgcccccggagaggugcuucugaaucucgaacugggcccugagcuuaacccguaccuggcucaccucgcccgcauguauaauggguacgcuggaggcauggagguucaggugaugcuggccggcaacgcguucaccgccgggaaacuggucuuugcugccgugcccccucauuuccccguugaaaaucucuccccucagcagauuacaauguuuccccacgugaucauugaugucagaacccuggagccggugcuucugccucuccccgacgugcggaacaauuucuuucauuauaaccaaaaggaugacccuaaaaugcgcaucgucgcuaugcuguacacaccccuuagaucuaauggaagcggcgaugacguuuucaccguguccugccgggugcugacgcgccccucuccugauuuugacuucaccuaucucgucccgcccacaguggaauuuaagaccaaaccuuucacacugcccauccugacccucggggagaugagcaacuccagauuuccuguucccauugaucagauguacacgagcccgaacgagaucauuucugugcagugucagaauggacggugcacacuggacggcgaacuucaagggaccacacagcugcaggucuccggaaucugugccuucaagggccaggugaccgcccaccuccaagauaacgagcaucuguauaauguuaccauuacaaaccuuaauggcagcccuuucgaccccucugaagacaucccugcuccccugggggugccugauuuugagggacgcgucuucggcgugauuucccagagagacaacuacaauagcgggggacagaaccaacccgcgaaucggucucacgaugccgucgugccgacguacaccgcucaguauacaccuaagcucggccagauccagaucgggaccuggcaaacagacgauauuaccguugaccagcccgccaaauuuacgcccgugggacuguccgauacagaccacagcaaccagugggucgugccucgcuacgccggcgcucugaaucucaacaccaaucuggccccguccguugcgcccguguucccuggcgaaagacuucuguuuuuccggucuuauaucccccucaaagggggauuuggcaacccugcuauugauugccuggucccccaggaguggauccaacauuucuaccaggaggccgccccuagccuuuccgaaguggcucuggcccgcuauauuaaucccgacaccgggagagcucucuuugaggccaagcugcaccgggcgggauucaugacagugagcucuaacaccuccgccccgguugucgugccugcuaacggcuacuuuagauucgauagcugggugaaucaguuuuauucucuggcccccauggggacaggcaacggacgccggagaauccaguga

SEQ ID NO: 28192 - RNA, 1623 nt, Artificial Sequence
  derived and/or modified sequence opt5 from capsid_protein__Norovirus__AFB18013
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaguuauuuucgcggccgugccucccaacuuuccuaccgagggacugagccccucccaggucacaauguucccgcauaucgugguggacgucagacaacucgagccuguucugaucccccugccugaugugcggaauaacuuuuaucacuacaaucagucuaacgaccccaccauuaagcucaucgcuaugcuguauacaccccuucgcgccaacaaugcuggcgaagauguguucaccgucagcugcagagugcugacacggccuuccccggacuuugauuucauuuuucucguucccccuaccguggagagccgcacgaaacccuucaccgucccuauccugacaguggaagagaugaccaacucuagauuucccauuccgcuugagaagcuguucacagggccuuccggagccuucguugugcagccccagaauggccgguguaccacggacgggguccuccugggaacaacccaacugagcccugugaacaucugcacauuucgcggcgaugucacccauauugccggcacccacaauuacacaaugaaccucgcuucucagaauuggaacaauuaugaccccacggaagagaucccugcgccccuggggaccccggauuucgugggaagaauccagggcaugcuuacacagaccacacgcggggacggauccacccggggccauaaagccacgguuagcacaggggacgugcacuuuaccccuaagcugggaucuauucaauucaacaccgauacaaauaacgacuuugaaaccggccagaauacaaaguucacgcccgucggcgugguucaggaugggaacggaacccaccaaaaugagccccagcagugggugcucccuuccuacagcggcagaacagggcauaacguccaccuggcuccggccguggcccccaccuuuccuggagaacagcuucuguucuuucgguccacaaugcccggcuguucuggguacccuaacaugaaucucgacugccugcugccccaagagugggugcagcauuucuaucaggaggcugccccugcgcagagcgauguugcucuccugcgcuuugucaaccccgacaccggcagagugcuuuucgaauguaaacugcacaaguccggauacgugacggucgcccacaccggccaacaugaucucgugaucccgccuaauggguauuuucgguucgacagcuggguuaaccaguucuacacacuggcccccaugggaaauggcaccgggagacgccgggcucuuuga

SEQ ID NO: 28193 - RNA, 1743 nt, Artificial Sequence
  derived and/or modified sequence opt5 from capsid_protein__Norovirus__AFJ05624
augaagauggccagcaacgacgcuaccgcccccucccaggauggcgcggcuaaucuggugccugaaucucaacacgaaguccucgcccuggagccgguugccggggcugcccuugcugcccccguggcgggacaguucaacgccaucgacccuuggauuaaacagaauuuugugcaggcucccgccggcgaguucacagucagcccuagaaacgcucccggggaaauccugauggaucucgaacugggaccugagcuuaauccguuucuggcccaucucgcgcaaauguacaacgccuaugcuggcgggauggaggugcagauuauccuggccggaaaugcuuucacggccggcaagauuaucguuugcgccgugcccccuaacuuucccccugaccggcuguccgcuucucaggcgaccaauuucccccacgucaucauggaugugcgcacacucgaaccgguuauucugccucuucccgacgugagagccggcuuuuuccauuacaaccagcugcgggagccucgcaugagacucauggcucugcuuuauacaccccugcgggccaaugggaccggagaugacgccuuuaccgucagcugucgcgugcucacaagacccaugcaagauuucgaauuuauguuccuggugccuccgaccgucgagucccggguuacgcccuuuucugugccuaccuaccccguggucgagaugacaaacagccgcuggccugcuagaaucuccggcaugcacgugaaugccaaccagacccuggcgguucaguuccagaaugggcggugcacacucgacggacaacugaugggcaccacgcagcuuugugcugccgaugugugccgcaugagagggcgguauacaagcacccgcgccgaccuggcuggagucgaucauacagaccagggccccucucucggcaccgggccguccgacgauagcgugucuguuccugaagccagagcucaaacccggacaggaguguccgcccaccuccagcuugaggaacugaacggccagcccuacgaggucuauggggaacagccugcgccccucggaacgccugacuucagaugucgccugaugggcgagcuggugcggcuccccagcaccucuccggccgcucaauccagauuucgcgaugccuucuuugacacauacggggcucuguucgccccugcggucggaagcaccacauuuaccgugaacaauuccucuacgagcgauuucgccaacggccagcccuuugaguuccuucccauuggcguugaaaucggaaauuccgcucaguacgacgaguuugcccugccuagcuauaacggggcuauuggcgaaaaucggcaccucgccccgguggccgcucccggguucccuggagagaacaucgucuuuuucucuuccaaucugcccgugugggauagcacaucugcgcagaacaauagacgcauuagcugccuucugccuaacgaauuuguucaacauuucuacgaccuccaggcccccucccagucugauguggcucugcugcgguauguccacccugagagcggcagagugcuguucgaguguaaacuguaccgcgacggguuucuuaccgugaauggcgccucccuggccgaguuccccguuaacggauauuuucgguucgauagcugggucaaucaguuuuucacccucucuccggugggcacaggguccggaagacgcggccggagcagaaacgcucaauga

SEQ ID NO: 28194 - RNA, 1746 nt, Artificial Sequence
  derived and/or modified sequence opt5 from capsid_protein__Norovirus__AFJ05628
augaagauggccagcaacgacgcugccucccccucuagcgauggcgcggcuaaucuggugccugagaucaacaaugaagucauggcccucgagccgguugccggggcucagcuggccgcucccguggccggacaauucaacgcgauugacccuuggaucagacagaauuuugugcaggcccccgaaggcgaguucaccgucuccccucggaacgcucccggggaaauucuucugaaucucgagcugggaccucaccuuaacccguuucugcagcaucucgcccaaauguacaaugcuuaugccggcgggauggaggugcagguugugcuggcgggaaacgccuucacagcuggcaagaucauuuuugccgcugugcccccucacuuucccccugaacgccugucugccgcccaggcuacgcaguucccccaugucaucguugaugugagacaacucgagccgaucauucugccucuucccgacguccggcacaaucuguuccauuuuaaccagcagaaugaugaacgcaugcaccucguggcguuccuguacaccccucuuagagccaacagcggcuccggggacgauguguuuacagucucuugccggguucugacccgccccagccaggacuucgaguuuauguuccucgugcccccuacaguggagaagaaaaccgucgcuuucucccugccgcaacuggccaucggagaaaugagcaauucuagauggcccgcccggauuacaggccucgugguugauccucgccugccccaggugcuucacauccagaacgggagauguacccuggacggaacgcucaugggcaccacacaacugaacccuaaugauauuugccggauccgcggguauuuuuccagcucuagacccgagcuucugugugaaaacgaggaauccgcuaccgacccgaugccuacagagaccgauacggacaaucagcccccugagguccgggcccaggcgcgcgcuacacagagaugguucgccgugaccgaacucaacggacaaguuuacgaccccuuuggcgaucagccugcuccccugggcgugccggacuucaaggcccggauucugggggcccucaugagacugccuggaacaaaucccaccagcaacucucgcuuugaggaugcuugggucgaaaccaauaaccagacaacguaugcccccgcggccggcguggucgcuaucaccacaaaugacaacuccagcuccaauuacgccaacgaucagaccugcgaguucgugccucuugggaucgaaauuacagacucugcuccguaucaugaguuugaucugcccagcuacggaggcgccgcguccagcgggaaucggaaccucgccccuaccguugcucccacguucccuggagaggccauccugcuuuuuggcucuaauaugcccguguacaacagaaacacaggcaccuccaauaaagacauucgcugucugcucccuaacgaauauguccaacaccuguacgauacccaggcucccagccugucugacguggcccucguucgguaugugaauagagauacagggcgcguccuguucgaggccaaacuucaucgggacggauuuaugaccgugaacgcuagcuccacaacggugcugccgguugacggcuacuucagauuugauucuugggucaaucaguucuaugcgcucagcccuguggggaacgccuccggacgccggggcagaagccgccagaccaauuga

SEQ ID NO: 28195 - RNA, 1623 nt, Artificial Sequence
  derived and/or modified sequence opt5 from capsid_protein__Norovirus__AFJ24945
augaagauggccagcaacgacgcuaaucccuccgauggcucugccgcgagccuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcuccacaacgcaccgcaaugaaccccagcaaugggugcugccuagcuacucuggcgggaacguucacaaugugcaucuugccccggcugucgcccccaccuuuccuggagagcagcuccuguucuuuagauccacaaugcccggcuguagcggguauccuaacauggaucuggacugccugcucccccaggagugggugcagcacuucuaccaagaagcggcuccugcccagucugauguggcccugcuucgguuuguuaaucccgacaccggacgcguccuguucgaguguaaacuccauaagagcggcuaugugacaguggcucacaccgggcagcacgaucuggucaucccgccuaacggcuacuuuagauucgacuccugggugaaccaguucuauacgcuugcccccaugggaaauggcaccgggcggagacgcgcucuguga

SEQ ID NO: 28196 - RNA, 1638 nt, Artificial Sequence
  derived and/or modified sequence opt5 from capsid_protein__Norovirus__AFK75851
augaugauggccagcaaggacgcucccccuaacauggauggcaccuccggggccggacagcuggugccggaggcgaauacagcugaacccaucucuauggagccugucgccggcgccgcuacggccgcugccaccgcggggcaaguuaacaugauugaccccuggaucaugaauaacuacgugcaggccccucagggagaguucacaauuagccccaauaacaccccuggcgauauccucuuugaccugcagcuugggccgcaccugaaucccuuccucucccaucuggcucaaauguauaacggaugggugggcaauaugaaagucaaggugcuucuggccggcaacgcuuuuacagccgggaaaauuaucaucucuugcauuccucccggauucgcggcccagaauaucagcauugcucaggccaccauguuuccucacguuaucgcugaugugagaguccucgaacccauugaagugccgcuggaggacguucggaacgugcuguuccauaauaacgauaauacaccuaccaugcgccucgucuguaugcuguacacgccccuuagagccuccggcucuagcuccgggaccgacccuuuugugaucgccggacgggugcugacaugccccagccccgauuucucuuuucucuuccuggucccuccgaacguugagcagaagaccaaacccuuuuccgugccuaaccuuccccugaauacacucagcaacucucgcgugccuucccugauuagaagcaugauggucucucgggaccacggccaaauggugcaguuccagaaugggcgcguuacccuggauggacagcuccaaggcacgacacccaccuccgcuagccagcuguguaagaucagaggcuccguguuucaugcgaacgggggaaauggcuauaaccuuacagaacuggacgggucuccguaccacgccuucgagagcccugcucccaucggauucccugaucucggcgaaugcgacuggcacauggaggccucccccaccacccaguuugacacaggggaugucauuaagcaaaucaaugugaaacaggaggccgcuuucgccccucaucugggaacgauucaggcggacggccuuagcgauguuucugugaacaccaauaugaucgcuaagcugggcugggucucccccgugagcgacgggcaccggggaucugucgauccgugggugauuccucgcuauggcagcacacucaccgaagccgcccagcuggcuccucccaucuaucccccgggguuuggagaggccaucguuuucuuuauguccgacuuccccauugcucauggcgccaacgggcugucugugccuuguacaaucccccaagaauuugucacccacuucgugaaugagcaggcgccuacgagaggcgaagccgcucuccugcacuaccuugaucccgacacacaucggaaccugggagaguuuaaacucuacccugagggcuucaugaccugcguucccaauagcuccgggaccggaccgcagacacugccuauuaacggcguguuugccuucgucagcugggugucucgcuuuuaccagcuuaagcccguggggaccgcuggaccugccagacggcugggcauccgcagauccuga

SEQ ID NO: 28197 - RNA, 1635 nt, Artificial Sequence
  derived and/or modified sequence opt5 from capsid_protein__Norovirus__AFK75852
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgagaugagcaagauccccaauuccucuacccagagcaacccgauugucgucaauuccgugaagccuaacagccagcaguucgugccccaucucucuuccaucacacuggaugacaauguuagcucuggaggcgauuacauuggcaccauccaauggacgagcccucccuccgacucugggggagcuaacacaaauuuuuggaaaauuccggauuauggcagcucccuggcggaagccagccagcucgcucccgccguguacccucccggguucaacgaggucaucguguauuuuauggccucuaucccuggacccaaucaguccggcagcccuaaccugguucccugucuucugccgcaggaauacauuacccacuucaucucugagcaagcuccuauucagggggaggccgcgcuccugcacuacguggaccccgauaccaaucggaaccuuggcgaauuuaagcuguauccuggaggcuaccucacaugcguccccaauuccagcuccaccgggccgcagcagcugccucuggacggaguguucguguuugcuucuuggguuagccgcuucuaucaacucaaacccgucggcacagccgggccugccagaggacggcugggcgugcgcagauga

SEQ ID NO: 28198 - RNA, 1641 nt, Artificial Sequence
  derived and/or modified sequence opt5 from capsid_protein__Norovirus__AFK75853
augaugauggccagcaaggacgcuucccagucugccgauggcgcgagcggggcuggacaacuggugcccgaggucaacaccgccgacccucucccgauggaacccguugccggcccuacaacggcuguggccaccgcuggacaggugaauaugaucgaucccuggauugucaacaauuucgugcaguccccucagggggaguuuacaaucucucccaacaauaccccuggcgacauucuguucgaucuucaacuggggccgcaccucaaccccuuucugagccaucuuucccagauguacaauggauggguuggcaacaugagagugcggauccugcucgccggcaaugcguucucugccgggaaaauuaucgucugcugugugccucccggauuuacaagcuccagccugaccaucgcucaggccacacuguucccucacguuauugcugacgugcgcacccucgaacccaucgagaugccgcuggaagaugucagaaacgugcuuuaucauacgaaugacaaccagccuaccaugcggcuggugugcaugcucuacacaccccugcgcaccggcgggggaucuggcaauuccgauagcuuugucguugccgggagagugcuuacagcgccuucuuccgacuucagcuuucuguuccucgugccucccaccauugagcaaaagacgcgggccuuuacaguccccaacaucccgcugcagacccugucuaauucccgcuuccccagccucauucagggaaugauccuguccccugaugcuucucaggugguucaauuucagaacggcagaugucuuauugacggccagcugcucgggacaacccccgccaccagcggacaacuguuccgggugcgcggcaaaaucaaccagggggcuagaacacuuaaucugacggaggucgauggaaagccuuucauggccuuugacucccccgccccggugggcuucccugacuuugggaaaugcgauuggcacaugcggaucagcaagacccccaacaauacaucuuccggagacccuaugcgcagcguuucugugcagaccaacguccagggcuucgugccccaucucggcagcauucaauuugaugaagucuucaaucacccuacaggggacuauaucggaaccauugaguggaucucccagcccucuacgccgccuggcacagauauuaaccugugggaaauccccgacuacgggagcucccugagccaggcugcgaaucucgcucccccuguguuuccgcccggauucggcgaggcccugguuuauuuugugucugccuucccugggcccaacaauagauccgccccuaacgauguccccugucuucugccucaggaguacaucacccacuuugugagcgaacaagcucccaccaugggcgacgccgcgcuccugcauuauguugauccggacacaaaucggaaccuuggagaguucaagcuguacccuggcggguaccugaccugcgugcccaauggagucggcgcugggccucagcagcucccccugaacggaguguuucucuucgugucuuggguuucccgcuucuaucagcugaaaccggucggcacagccagcacggccagagggcggcuuggcgugagacgcauuuga

SEQ ID NO: 28199 - RNA, 1647 nt, Artificial Sequence
  derived and/or modified sequence opt5 from capsid_protein__Norovirus__AFK75854
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaagugaucuucgcugccauucccccuaacuuucccauugacaaucuguccgcugcccagaucaccaugugcccucaugucauuguggauguucgccaacuggagcccaucaaccucccgaugccugacgugagaaauacauucuuucacuauaaccaggauucugacagccggcugcgccuuauugccaugcuguacacaccccucagagcuaacaauuccggcgaugacgucuucaccgugucuugucgggugcugacccgcccuagccccgauuuuuccuucaacuuucuuguucccccuacagucgaaagcaagaccaaacuguucacgcucccgauccugaccauuucugagauguccaauagcagauuucccgugccuaucgacucucugcauacaucccccaccgaaaacaucgugguccagugccagaaugggcgggugacacucgauggagagcugaugggcaccacgcaacuucugccuagccagauuugugcguuccgcgggacacucaccagaucuacaucccgggccagcgaccaggcugacacccccaccccgcgccuguucaaccacagauggcauauccagcuugauaaucugaacggaacaccuuaugaccccgccgaggauauuccugcuccccucggcacgccugacuuucggggcaagguuuucgggguggccucccaacgcaaucccgauucuaccacaagagcccacgaagcgaaagucgacaccacaagcggacgguuuaccccgaagcugggcucccuggagaucacgacagaaagcgaugacuucgauaccaaccagucuaccaaguuuacaccuguggggauuggaguugacaaugaggcugaguuccagcaauggucccuccccaacuacagcggccaguuuacccacaauaugaaccuggcccccgccguggcuccuaauuucccgggggaacagcuucuguuuuucagaucucagcuccccagcuccggaggcuggucuaacggcguccuggauugccuugugccucaagaguggguccagcauuuuuaucaggaaagcgcccccgcucagacacaaguggcccugguucgcuacgugaacccugacacggggcggguccucuucgaggcgaaacugcacaagcugggauuuaugaccaucgccaaaaauggcgacucccccaucacagugccucccaacggguacuucagauucgaaagcuggguuaauccguuuuauacccucgcuccuaugggaacaggcaacgggcgccggagaauccaguga

SEQ ID NO: 28200 - RNA, 1671 nt, Artificial Sequence
  derived and/or modified sequence opt5 from capsid_protein__Norovirus__AFN61315
augaagauggccagcuccgacgcugcccccucugcggauggcgcugggaaccuggugccugagagccagcaagaaguccucccgcuggcccccguugccggagcugcccuugcugccccuguggugggccagaccaauaucauugaccccuggaucaaggagaacuucguccaggcgccucagggggaauuuacagugucccccaagaacucuccuggagagauucugguuaaucucgaacugggcccgaaacuuaaucccuaccuggaucaccucagcagaauguauaacuccuacgccgggggaaucgacgugauggucgugcuggcuggcaaugccuucacggcuggcaagguucugauugccgcgaucccucccaacuuuccuguggagggggucucugccagccaagcuacccaguucccccaugugaucauugaugugcggacacucgacccgguccgccugccucuucccgauguuagauccaccuuuuuccacuauacaaaugacaccgagccuaaaaugcggcuggugaucuggcucuacacaccccugcgcaccaacggaagcggcgaugacucuuuuacgguguccgggcggauucuuaccagacccagccaggauuucgaauuugccuuccugaucccuccgacagucgagaccaagacaacccccuuuucugugccuggauucuccguucaggaaaugagcaauucucgcuggcccgcugccauuuccgccaugguggucagaggcaacgagccucaagugguucaguuucagaaugggcgggcucaucucgacggaaugcugcugggcacgacacccgugagcccgaacuauaucgcguccuaccgcggcauuucuaccgggaauagcagauccgccagcucugaggcugaugaacgggccgucggauccuucgacguguggauccgccuccaggagccugacggccaacccuaugauaucuucgggaagcagccugcccccauuggaacaccugacuuuaaagcugucaucgugggcuucgccgcgagaccccugaccagcgggucuuacgcuaacgaagccuacguuaacaccacagccagcgauuaugcuccggccacgggaaauaugcgguuuaccgugcgcaacggcggcacagggcacauuuccgcuaauaaguacugggaguucagaucuuuuggagucgaaggcgagcggcauaccgacgugcaguaucaagaguacgaacuuccugauuauagcgggcagguugccuccaaccacaaucuggcgccucccguggcccccagaaugccgggagagagccuccugcuuuuccagucuaacaugcccgucugggacgauggccgcggggaauccacaccuaaaaagauccacugccugcucccccaggaguuuauuggccauuucuuugacaaacaagcuccuagccugggagaugccgcucugcuccgguacgugaaucaggaaaccaacagagugcuguucgaguguaaacuuuaucgcgacggcuacaucacgguugccgcggccucugggcugcucgauuuuccccuggacggauucuuucgguucgacuccugggucagcuccuucuacauccuuucuccugugggcagcgggcagggaagacgcggccgggugagauuucaguga

SEQ ID NO: 28201 - RNA, 1623 nt, Artificial Sequence
  derived and/or modified sequence opt5 from capsid_protein__Norovirus__AFQ00511
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagagcggcuaugugacaguggcucauaccgggcagcacgaucuggucaucccucccaacggcuacuuucgguucgacucuugggugaaucaguucuauacgcuugccccuaugggaaacggcaccgggagacgccggguucuguga

SEQ ID NO: 28202 - RNA, 1623 nt, Artificial Sequence; identical to SEQ ID NO: 27081
  derived and/or modified sequence opt5 from capsid_protein__Norovirus__AFQ00512

SEQ ID NO: 28203 - RNA, 1623 nt, Artificial Sequence
  derived and/or modified sequence opt5 from capsid_protein__Norovirus__AFQ00513
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccccguuuacgccuaaacucggguccguucaguucucuacagauaccgagaacgacuuugaaacccaucaaaauacaaaguucacccccgugggagucauucaggauggcagcacaacgcaccgcaacgagccccagcaaugggugcugccuuccuacagcggcagaaauguucagaacgugcaccuugccccggcugucgcccccaccuuuccuggggaacagcuccuguucuuucggucuacaaugcccggauguuccggcuauccuaauauggaccuggauugccugcucccccaggagugggugcaacauuucuaccaggaggcggcuccugcccagagcgacguggcccugcuucgcuuuguuaaccccgauaccgggagaguccuguucgaauguaaacuccacaagucuggauaugugacaguggcucauaccggccagcacgaccuggucaucccgccuaacggguacuuucgguucgauagcugggugaaucaauucuauacgcuugcccccaugggcaacggaaccggcagacgccgggcucuguga

SEQ ID NO: 28204 - RNA, 1623 nt, Artificial Sequence
  derived and/or modified sequence opt5 from capsid_protein__Norovirus__AFQ00516
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucggaacagacaccgaaaaugauuuugagacccaucaaaacacaaaguucacccccgugggcgucauucaggacggcgggacaacgcaccgcaaugaaccccagcaaugggugcugccuagcuacuccggaagaaacguuccgaaugugcaccuugcccccgcugucgccccuaccuuucccggcgagcagcuccuguucuuucggagcacaaugccuggguguucuggauaucccaacauggaucuggacugccugcucccucaggagugggugcagcauuucuaccaagaagcggcucccgcccaguccgauguggcccugcuucgcuuuguuaauccggacaccggcagaguccuguucgaguguaaacuccacaagagcggguaugugacaguggcucauaccggccagcacgaucuggucaucccucccaacggauacuuucgguucgacucuugggugaaccaguucuauacgcuugccccuaugggcaaugggaccggaagacgccgggcucuguga

SEQ ID NO: 28205 - RNA, 1623 nt, Artificial Sequence; identical to SEQ ID NO: 27081
  derived and/or modified sequence opt5 from capsid_protein__Norovirus__AFQ00517

SEQ ID NO: 28206 - RNA, 1623 nt, Artificial Sequence; identical to SEQ ID NO: 27746
  derived and/or modified sequence opt5 from capsid_protein__Norovirus__AFQ00518

SEQ ID NO: 28207 - RNA, 1623 nt, Artificial Sequence
  derived and/or modified sequence opt5 from capsid_protein__Norovirus__AFQ00519
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacacggggcgacggguccacccgcggacacaaggcuacaguguacaccggcagcgccccguuuacgccuaagaugggguccguucaguucucuacagacaccgaaaacgauuuugagacccaucaaaauacaaaauucacccccgugggagucauucaggacggcggcacaacgcacagaaacgaaccccagcaaugggugcucccuagcuacuccgggcggaauguuccgaacgugcaccuggcccccgcugucgccccuaccuuucccggagagcagcuucuguucuuucgcagcacaaugccuggcuguucuggguaucccaauauggaucucgacugccugcugccucaggagugggugcagcauuucuaccaagaagcggcucccgcccaguccgauguggcccuccugagauuuguuaacccggacaccggacggguccuuuucgaguguaagcugcacaaaagcggcuaugugacaguggcucauaccgggcagcacgaucucgucaucccucccaacggcuacuuuagauucgacucuugggugaaucaguucuauacgcuggccccuaugggaaacggcaccgggcgccggagagcucuuuga

SEQ ID NO: 28208 - RNA, 1623 nt, Artificial Sequence
  derived and/or modified sequence opt5 from capsid_protein__Norovirus__AFQ00520
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugccgaacguucaccuugcccccgcuguggccccuaccuuucccggggagcagcuccuguucuuucggucuacaaugccuggauguuccggcuaucccaauauggaucuggacugccugcucccucaggaguggguccagcauuucuaccaagaagcggcucccgcccagagcgauguggcccugcuucgcuuugugaacccggacaccgggagaguucuguucgaguguaaacuccacaagccuggauaugucacaguggcucauaccggccagcacgaucuggugauucccccuaacggguacuuucgguucgacucuugggucaaucaguucuauacgcuugcccccaugggcaacggaaccggcagacgccgggcucuguga

SEQ ID NO: 28209 - RNA, 1623 nt, Artificial Sequence
  derived and/or modified sequence opt5 from capsid_protein__Norovirus__AFQ00521
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucagaacgugcaccuugccccggcugucgcccccaccuuuccuggagagcagcuccuguucuuucggagcacaaugcccggcuguucuggguauccuaauauggaucuggacugccugcucccccaggagugggugcaacauuucuaccaggaagcggcuccugcccaguccgauguggcccugcuucgcuuuguuaaccccgacaccggaagaguccuguucgaguguaaacuccacaagagcggcuaugugacaguggcucauaccgggcagcacgaucuggucaucccgccuaacggcuacuuucgguucgacucuugggugaaucaauucuauacgcuugcccccaugggaaacggcaccgggagacgccggguucuguga

SEQ ID NO: 28210 - RNA, 1623 nt, Artificial Sequence
  derived and/or modified sequence opt5 from capsid_protein__Norovirus__AFQ00522
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguuccgaacgugcaccuugcccccgcugucgccccuaccuuucccggagagcagcuccuguucuuucggagcacaaugccuggcuguucuggguaucccaauauggaucuggacugccugcucccucaggagugggugcagcauuucuaccaagaagcggcucccgcccaguccgauguggcccugcuucgcuuuguuaacccggacaccggaagaguccuguucgaguguaaacuccacaagccuggcuaugugacaguggcucauaccgggcagcacgaucuggucauucccccuaacggcuacuuucgguucgacagcugggugaaucaguucuauacgcuugcccccaugggaaacggcaccgggagacgccgggcucuguga

SEQ ID NO: 28211 - RNA, 1623 nt, Artificial Sequence; identical to SEQ ID NO: 28210
  derived and/or modified sequence opt5 from capsid_protein__Norovirus__AFQ00523

SEQ ID NO: 28212 - RNA, 1623 nt, Artificial Sequence; identical to SEQ ID NO: 27746
  derived and/or modified sequence opt5 from capsid_protein__Norovirus__AFQ00524

SEQ ID NO: 28213 - RNA, 1623 nt, Artificial Sequence; identical to SEQ ID NO: 27746
  derived and/or modified sequence opt5 from capsid_protein__Norovirus__AFQ00525

SEQ ID NO: 28214 - RNA, 1623 nt, Artificial Sequence
  derived and/or modified sequence opt5 from capsid_protein__Norovirus__AFQ00526
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagccacaauuacgcgaugaaccucgccucucugaauuggaacaauuaugacccuaccgaagagauucccgcuccucuuggcacccccgauuucguggggaaaauccagggaguccugacacagacgaccaagggcgacggguccacaagaggacauaaggccaccauuuacacaggcagcgccccguuuaccccuaaacucggguccgugcaguucucuacggacacagaaaacgauuuugagacccaccaaaauaccaaguucacacccguuggagugauccaggacggcggcaccacacaccggaacgaaccccagcaauggguccugccuagcuacuccgggcgcaaugugccgaacguucaucuugcucccgccguggcgccuacguuucccggagagcagcuccuguucuuuagaagcaccaugccuggcuguucuggguaucccaauauggaucuggacugccugcucccucaggaguggguccagcacuucuaccaagaagcugcccccgcccaguccgauguggcucugcuucgguuugugaacccggacacaggacgcguucuguucgaguguaaacuccauaagagcggcuaucugaccgucgcccacacagggcagcacgaucuugugauuccucccaacggcuacuuuagauucgacucuugggugaaucaguucuauacccuggcuccuaugggaaacggcacggggcggagacgcgcccucuga

SEQ ID NO: 28215 - RNA, 1623 nt, Artificial Sequence; identical to SEQ ID NO: 27746
  derived and/or modified sequence opt5 from capsid_protein__Norovirus__AFQ00527

SEQ ID NO: 28216 - RNA, 1623 nt, Artificial Sequence
  derived and/or modified sequence opt5 from capsid_protein__Norovirus__AFQ00528
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgaccccacaauuaagcucaucgccaugcuguauacaccccuucgcgcuaacaaugccggcgaagauguuuucaccgugagcugcagagugcugacccggccuuccccggacuuugauuucauuuuucucgugcccccuacagucgagagccgcaccaaacccuucacgguuccuauccugaccguggaagagaugacaaacucuagauuucccauuccgcuugagaagcuguucaccgggccuuccagcgccuucgucgugcagccccagaauggacgguguacaaccgacggcguucuccuggggacgacacaacugucuccugugaacaucugcaccuuucgcggagaugucacacauaucgcuggcuccagaaauuacaccaugaaccucgcgagccugaauuggaacaauuaugaccccaccgaagagauuccugcuccccuuggcacaccggauuucguggggaaaauccagggaguccugacgcagaccacaaagggcgacgggucuacccggggacacaaggccacaguguacaccggcuccgccccuuuuacgcccaaacucgggagcguucaguucuccacagacaccgaaaacgauuuugagacccaucaaaauacaaaguucacccccgugggagucauucaggacggcggcacaacgcaccgcaacgaaccucagcaaugggugcugccgucuuacagcgggagagauguucccaaugcccaccuugcuccugccguggcgcccaccuuuccuggagagcagcuccuguucuuucgguccacaaugcccggcuguagcggguauccuaacauggaccuggauugccugcucccccaggaguggguccagcauuucuaccaagaagcugccccggcccagucugacguggcucugcuucgcuuugugaauccugauaccggaagaguucuguucgaguguaaacuccacaaguccggcuaugucacaguggcccauaccgggcagcacgaccuggugauucccccuaacggcuacuuucgguucgauagcugggucaaccaguucuauacgcuugcucccaugggaaauggcaccgggagacgccgggcccuguga

SEQ ID NO: 28217 - RNA, 1644 nt, Artificial Sequence
  derived and/or modified sequence opt5 from capsid_protein__Norovirus__AGC66782
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccuagaaauucccccggggaaaugcugcuuaaccuggagcucggaccugagcugaauccguaccuuucucaccugagccgcauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaucggcagaugcacacuggacgggucccuucagggaaccacgcagcuggugccuacacaaauuuguagcuuuggcgggacccucaucucucagacaucccggagcgccgauucuaccgacuccgcuccccgcguuagaaaucacccucugcaugugcagcuuaagaaccuggauggaacccccuacgacccuacagacgagguccccgcggugcucggcgccaucgauuucaaaggcacggucuucgggguggcuagccaacggaauaccacaggaggcuccguuggggccacccgcgcccacgaagugcacauugacacaaccaacccgagauauacgccuaagcugggaucugcucugauguacagcgaguccgaugacuuugaugacggccagcccacacgguucacccccaucgggaugggagccgaugacuggcaucagugggagcucccugaauacagcggccaccugacccuuaauaugaaccuggcgccggcugucgcccccgccuuuccuggcgagcggauucucuucuuucgcucugugguucccuccgcugggggauauggcagcgggcagaucgauugccugauuccucaagaaugggugcagcauuucuaccaggaggccgcucccucucagagcgccgucgcgcuuauccgguaugugaauccugacacaggaagaaacauccuggaagccaagcuccaccgcgagggcuuuauuaccguggcuaauuccgggaacaaucccaucguugucccgccuaacggcuacuuccgguuugaggccugggugaaucaauucuauacacugacgcccaugggaaccggccaggggagacgccgggugcaguga

SEQ ID NO: 28218 - RNA, 1623 nt, Artificial Sequence
  derived and/or modified sequence opt5 from capsid_protein__Norovirus__AGC66784
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcucugacuuugauuucauuuuucucgucccuccgacaguggagucccgcaccaaacccuucacgguuccuauccugaccguggaagagaugacaaacagcagauuucccauuccucuugagaagcuguucaccgggcccucuuccgccuucgucgugcagccgcagaauggacgguguacaaccgacggcguucuccuggggacgacacaacugagcccugugaauaccugcacauuucgcggagaugucacccauaucgcuggcucuagaaacuacaccaugaaccucgcgucccugaauuggaacaauuaugaccccacagaagagaucccugcuccccuuggcacgccugauuucguggggaaaauucagggaguccugacccagacaaccaagggcgacgggagcacacggggacacaaggccaccaucuacacgggcuccgcccccuuuacaccgaaacucgggucugugcaguucaacaccgacaccgaaaaugauuuugagacacaucaaaacaccaaguucacaccuguuggagugauucaggacggcggcacgacccaccgcaaugaaccccagcaauggguccugcccagcuacuccgggagaaacaucccuaaugugcaccuugccccggcuguugcccccacauuuccuggagagcagcuccuguucuuucggagcaccaugcccggcuguucuggguauccuaacauggaucuggacugccugcucccccaggagugggugcagcauuucuaccaagaagcggcuccugcccaguccgaugucgcccugcuucgcuuugugaaccccgacacaggaagagugcuguucgaguguaaacuccacaagagcggcuauguuaccgucgcucauacggggcagcacgaucuggugauuccgccuaauggcuacuuucgguucgacucuugggugaaccaguucuauacccuugcccccaugggaaauggcacagggagacgccgggcucuguga

SEQ ID NO: 28219 - RNA, 1647 nt, Artificial Sequence
  derived and/or modified sequence opt5 from capsid_protein__Norovirus__AGC66785
augaagauggccagcaacgacgcuacccccuccaaugauggcgccgcggggcuggugccugagaucaacucugaagcuauggcccucgagccggucgccggagcugccauugcugcgccccugacaggccagcaaaauaucauugacccuuggaucaugaacaauuucguucaggcccccgggggagaauuuacggugagcccuagaaacucccccggcgaggugcuucugaaucucgaacuggggccugagauuaacccguaccuugcccaccuggcucggauguauaauggauacgccggcggcuucgagguccaggugguucucgcugggaacgccuuuaccgcgggaaaaaucaucuucgccgcuauucccccuaauuuucccaucgauaaccugucugccgcucagauuacaaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagccaacaauucuggggaugacgucuucaccgugagcugucgggugcugacccgcccuucccccgauuuuagcuucaacuuucuuguucccccuacagucgagucuaagaccaaaccguucucccugcccauccucacgauuagcgaaaugucuaauuccagauuuccugugcccaucgacagccugcauaccucuccuacagagaacaucgugguccagugccagaauggacgggugacccuggauggcgagcucauggggacaacccaacugcuucccucccagauuugugcuuuccgcggaaugcugacgagaagcacaucccgggcgucugaccaggccgauaccgcuacaccgcgccucuucaacuauuacuggcacauccagcuggacaaucuuaacggcaccccuuaugaccccgccgaagauauuccuggcccccuggggaccccugacuuuagaggaaagguuuucggcguggccagccaacggaaucccgaugcuacaacgcgcgcccaugaggcgaaaaucgacaccacauccgggagauuuaccccgaagcucggaagccuggaaauuucuacagaguccggcgauuucgaccagaaccagccuacccgguuuacgcccgucgggaucggaguggauagagaagcugacuuccaacaguggacacugcccgauuacgccggccaguuuacccacaauaugaaccucgccccugcuguugccccgaauuuccccggcgagcagcugcuguuuuuccgcagccaacuuccuucuagcgggggacgguccaacggcauccucgacugccuggugccccaggaguggguccagcacuuuuaccaggaaucugcuccuagccaaacccagguggcccuugucagauauauuaaucccgauacagggcgcgugcuguucgaggcgaagcuccauaaacugggauuuaugaccaucgccaaguccggcgacagcccuauuacaguucccccgaacggguacuuccgguucgaaucuugggugaacccuuuuuauacgcuggcucccaugggcaccggaaauggcagacgccggauccaguga

SEQ ID NO: 28220 - RNA, 1644 nt, Artificial Sequence
  derived and/or modified sequence opt5 from capsid_protein__Norovirus__AGC66786
augaagauggccagcaacgacgcugcccccuccaaugauggcgcggcuaaccuggugccugaggccgacaaugaagucauggcccucgagccgguugugggggcuucuaucgccgcucccguggucggacagcaaaacauuaucgauccuuggauuagagaaaauuucgugcaggcgccccagggcgaguuuaccguuagcccucggaacucccccggggaaaugcugcuuaaucuggagcucggaccuggccugaacccguaccuuucucaccugagccgcauguauaauggguacgccggaggcaugcaagugcaggucgugcucgccggcaacgcuuucacagccgggaagaucauuuuugcugccguucccccucauuuccccguggagaauaucuccgcggcccagaucacgaugugcccucacgucauuguggacgugagacagcuggaacccguccugcucccgcugccugauauccggaaccgcuuuuuccauuauaaucaggaggacacccccagaaugcggcuuguugcuaugcuguacacaccucuccgcgccaacucuggagaagauguguuuaccgugagcuguagaguccugacacggcccgcucccgacuucgaguuuaccuuccuugugccuccgacaguugaguccaagaccaaacccuuuacgcugccuauucucacccugggcgaacugagcaauucucgcuuccccgccccuaucgauaugcucuauacagaccccaacgagaccauugugguccaaccgcaguccgggagaugcacacuggauggaacccuucagggcacgacacagcuggugccuacccaaaucuguagcuuucgggggacacucauuucucagaccucccgcagcgccgacucuaccgauuccgcucccagaguucggaaccacccuccccaugugcagcugaagaaucuugacggaacaccuuacgaccccacggaugaagucccggcggugcugggcgccaucgacuucaaaggcaccgucuucgggguggcuagccaacgcaacacaaccggaggcuccguuggggccacaagagcccacgaggugcacaucgauaccacgaauccucgguauacacccaagcucggaucuguccugauguacagcgaauccgacgauuuugacgauggccagcccaccagauucaccccuauugggaugggagcugacgauuggcaucagugggagcugccggaguacagcggccaccucacacugaacaugaaucuugcccccgcgguggcuccugccuuucccggcgaacgcauccuguucuuucggucuguugugccuuccgccgggggauauggcagcgggcagauugacugccucaucccccaagaguggguccagcauuucuaccaggaagcugccccuucucagagcgcuguggcccugauuagauaugugaaccccgauaccggacgcaauaucuuugaggcgaaacuucaccgggaaggcuucaucacaguugccaacuccgggaauaacccgauugucgugccucccaauggcuacuuuagauucgaggcuugggugaaccaauuuuauacgcugaccccuaugggaacaggccaggggcgccggagaguccaguga

SEQ ID NO: 28221 - RNA, 1623 nt, Artificial Sequence
  derived and/or modified sequence opt5 from capsid_protein__Norovirus__AGC66788
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucgcuucucuacagacaccgaaaacgauuuugagacccaucagaauacaaaguucacccccgugggagucauucaagacggcggcacaacgcacagaaacgaaccccagcagugggugcugccuaauuacagcggguccgauguuccgaacgugcaccuugcccccgcugucgccccuaauuuucccggagagcaacuccuguucuuucggagcaccaugccuggcuguucuggguaucccaacauggaccuggauugccugcucccucaggagugggugcagcauuucuaccaggaagcggcucccgcccaauccgacguggcccugcuucgcuuuguuaacccggauacaggaagaguccuguucgaguguaaacuccacaagagcggcuaugugaccguggcucauacagggcagcacgaccuggucaucccucccaauggcuacuuucgguucgauucuugggugaaccaguucuauacccuugccccuaugggaaauggcacggggagacgccgggcucuguga

SEQ ID NO: 28222 - RNA, 1629 nt, Artificial Sequence
  derived and/or modified sequence opt5 from capsid_protein__Norovirus__AGL96587
augaagauggccagcaacgacgcugcccccuccaaugauggcgcggcuucucuggugccugaggggaucaacgaaaccaugccgcucgagcccgucgccggagccagcauugcugccccuguugcuggccagacaaauaucauugaccccuggaucagaacgaacuucgugcaagccccuaauggggaauuuaccgugucuccccggaacuccccuggagagauucugcuuaaucuggaacucggcccggaucugaaccccuaccuugcgcaucugccucgcauguauaauggguacgccggaggcgucgaggugcagguucuccuggcuggcaacgccuucacagcugggaaaauccuguuugccgcgauucccccuaauuuccccguggacaugaucagcccggcccagaucaccaugcucccucaccugauugucgaugugagaacacuugagcccaucaugauuccucugcccgacguucggaacguguuuuaucacuucaauaaccagccccaaccucgcaugagacucgucgcuaugcuguacaccccgcuucgguccaauggaucuggcgaugacgugcugacagugagcugccgcguccucaccagacccacgccugauuuugaguucaucuaucugguucccccuuccguggaaagcaagaccaaacccuuuacacugccgauucucaccaucucugaacugacaaacucccgguucccuauccccauugagcagcuuuacaccgccccuaacgagacgaaugugguccagugucagaacgggcgcugcacacuggacggagaacuccaaggcaccacacagcugcuuagcucugcuguguguuccuauagagggcggaccguugccaauaacggagauaauugggaccagaaccugcuccagcugaccuaccccaauggcgccagcuacgauccuacagacgaggugcccgcuccgcugggcacgcaagacuuuucugggaugcucuauggaguccugacccaggauaacgugaauguuuccacaggcgaagcgaagaacgccaaagggaucuacauuagcaccacauccggaaaguucaccccuaagaucggcucuauugggcuucauagcaucacggagcacgugcaucccaaucagcaaucccgcuuuacacccgucggaguggcugucaacgaaaauaccccuuuccagcagugggugcugccgcacuaugccggcagcaccagaucucacacaaaccucggcaccgcccuggcucccacauucccuggggagcagcuucuguuuuuccggucccgcguucccugcgugcaaggacuccagggccaggacgccuuuaucgauugucugcugccucaggagugggucaaucauuucuaccaagaagcggcucccagccaggccgacguggcccucauuagauauguuaacccugauacggggcggacccuguuugaggcuaaacuucacagaucuggauucaucacagugagccauaccggcgccuacccccuggucgugccgccuaacgggcacuuucgcuucgacuccugggugaaucaguuuuauucucucgcucccaugggcacaggaaacggccggagacgcauucaguga

SEQ ID NO: 28223 - RNA, 1623 nt, Artificial Sequence
  derived and/or modified sequence opt5 from capsid_protein__Norovirus__AGQ57036
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagccccagaaauuccccuggagagauccuucuggaucucgaacugggcccggagcuuaaccccuaccuggcccaccucgcgcgcauguauaaugggcaugccggaggcauggagguucagauugugcuggcuggcaacgccuucacggcugggaaaaucaucuuugccgcgauuccucccggauucccuuacgaaaaucugucucccagccagaucaccaugugcccgcacgucauuaucgacgugagacaacucgagccuguucugcuucccaugccugauauucggaacaacuuuuuccauuauaaucagggcaaugaccccaagcugcgccucguggccaugcuguacacaccccuuagagcuaacaacuccggggaugacgucuuuaccgugucuugucgggugcugacaaaaccuagcccggauuucgaauuuaccuuccucguucccccuacagucgaguccaagaccaaacaguuuacgcugcccauccugaagauuagcgagaugaccaauucucgcuucccugugcccguggaaaugauguauacagccagaaacgagaaucaggucgugcaaccgcagaacggacggguuacccucgacggcgaacugcuugggacaaccccucugcucgcugugaauaucugcaaguuuaaaggagaggucaucgccaagaacggcgaugugcgcuccuacagaauggacauggaaauuacgaauacagauggcacccccaucgacccuacagaggacacccccgggccuauuggaagccccgauuuccagggcauccuguucgggguugccucucagcggaacaaaaaugagcaaaacccggcuacccgcgcgcacgaagccgacauuaauacaggaggcgaucaguaugcuccuaaacuugcccaggugaaguuuuucuccgagagccaagacuuugaaguccaucagcccacgguguucacccccgucgggguggccggagaugcuucucacccuuuuagacaguggguucugccgcgguacggcggccaccucacaaacaauacccaucuggcccccgcgguggcuccucuguuccccggggagcagauccucuuuuuccgcucccaaaucccuagcuccggaggccacgaacugggguacauggacugucuugucccccaggagugggugcagcauuuuuaucaggaggccgccacagcucaaucugaaguugcccugauuagauucaucaacccugauaccggacgggugcucuuugaggcuaagcugcacaagcagggcuucauuacggucgcccacacaggggacaaucccaucgugaugccgccuaacggcuacuuuagauucgaagcgugggugaaccaguucuauagccuugcccccguuggaaccggcaaugggcgccggcggauucaguga

SEQ ID NO: 28224 - RNA, 1623 nt, Artificial Sequence
  derived and/or modified sequence opt5 from capsid_protein__Norovirus__AGT95926
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggagacgcgucguguga

SEQ ID NO: 28225 - RNA, 1623 nt, Artificial Sequence
  derived and/or modified sequence opt5 from capsid_protein__Norovirus__AGT95927
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccacaccgcuugagaagcuguucaccgggccuucuuccgccuucgugguccagccccagaacggacgguguacaaccgauggcgugcuccuggggacgacacaacugagcccugucaauaucugcaccuuucgcggagacgugacacauauuaccggcucuagaaacuacaccaugaaucucgcuucccagaacuggaauaacuaugaucccacagaggaaaucccugcgccccugggcacgccggacuucguugggaaaauucagggagugcuuacccagacaacccggacagacggcagcacccgcgggcacaaggccacggucuacacaggauccgcugauuuugccccuaagcugggcagagugcaauucgagaccgacaccgaucaugacuuugaaguuaaucagaacacaaaauucacccccgugggggucauccaggauggaggcacaacgcaccggaaugagccccaacagugggugcucccuucuuacagcggccgcaacacccacaaugugcaucuggccccggcuguugcccccacauuuccuggggaacagcuucuguucuuuagauccaccaugcccggauguagcggcuauccuaacauggaccucgauugccugcugccccaggaguggguccaauacuucuaucaggaggcggcuccugcccagucugacguggcccuccugcgguuugugaaucccgauacagggagaguccuuuucgaauguaagcugcacaaauccggauacgugaccguugcucauacgggccagcacgaccucgugaucccgccuaacggguauuuucgcuucgauagcugggucaaccaauucuacacccuggcccccaugggcaauggaacaggccggagacgcgugguuuga

SEQ ID NO: 28226 - RNA, 1623 nt, Artificial Sequence
  derived and/or modified sequence opt5 from capsid_protein__Norovirus__AGT95928
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucucuauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggaaugcuuacgcagaccacacgggccgacggcuccacccgcgggcacaaggcuacaguguacaccggaucugccgauuuugccccuaagcugggcagaguccaauucgagacggacacagaucaugacuuugaagcuaaccagaauaccaaauucacccccguggggguuauccaggauggaagcacaacccaccggaacgagccccaacagugggugcucccuuccuacagcggccgcaauacacacaacguccaucuggccccggcgguggcucccacguuuccuggcgaacagcuucuguucuuuagaucuaccaugcccggguguuccggauauccuaauauggaccucgauugccugcugccccaggagugggugcaauacuucuaucaggaggccgccccugcucagagcgacguugcccuccugcgguuugucaaccccgauacaggcagagugcuuuucgaauguaagcugcacaaaucuggguacgugaccgucgcucauacaggacagcacgaccucgugauuccgccuaauggcuauuuucgcuucgauagcuggguuaaccaauucuacacccuggcccccauggggaacggcacgggacggagacgcguggucuga

SEQ ID NO: 28227 - RNA, 1623 nt, Artificial Sequence
  derived and/or modified sequence opt5 from capsid_protein__Norovirus__AGT95929
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaucuaccacacaccggaaugagccccaacaguggguccucccuagcuacuccggccgcaacacgcacaaugugcaucuggcuccggccguggcgcccaccuuuccuggcgaacagcuucuguucuuuagaagcacaaugcccggguguucuggauauccuaacauggaccucgauugccugcugccccaggaguggguucaauacuucuaucaggaggcugccccugcccaguccgacgucgcucuccugcgguuugugaaucccgauaccggcagagugcuuuucgaauguaagcugcacaaaagcggguacgucacaguggcccauaccggacagcacgaccucguuauuccgccuaacggcuauuuucgcuucgauucuugggugaaccaauucuacacgcuggcucccauggggaauggcaccggacggaagagagucguguga

SEQ ID NO: 28228 - RNA, 1623 nt, Artificial Sequence
  derived and/or modified sequence opt5 from capsid_protein__Norovirus__AGT95930
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccacagauuuugcuccuaagcugggcagagugcaauucgagaccgacaccgaucaugacuuugaagccaaucagaacacaaaauucacccccguuggggugauccaggauggaucuacaacgcaccggaaugagccccaacaguggguccucccuagcuacuccggccgcaacacccacaaugugcaucuggccccggcuguggcccccacauuuccuggcgaacagcuucuguucuuuagaagcaccaugcccggguguucuggauauccuaacauggaccucgauugccugcugccccaggaguggguucaauacuucuaucaggaggcggcuccugcccaguccgacgucgcccuccugcgguuugugaaucccgauacaggcagagugcuuuucgaauguaagcugcacaaaagcggguacgucaccguggcucauacgggacagcacgaccucguuauuccgccuaacggcuauuuucgcuucgauucuugggugaaccaauucuacacccuggcccccauggggaauggcacaggacggagacgcgcugucuga

SEQ ID NO: 28229 - RNA, 1623 nt, Artificial Sequence
  derived and/or modified sequence opt5 from capsid_protein__Norovirus__AGT95931
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaaaccaaucagaacacaaaauucacccccguuggggugauccaggauggaucuacaacgcaccggaaugagccccaacaguggguccucccuagcuacuccggccgcaacacccacaaugugcaucuggccccggcuguggcccccacauuuccuggcgaacagcuucuguucuuuagaagcaccaugcccggguguucuggauauccuaacauggaccucgauugccugcugccccaggaguggguucaauacuucuaucaggaggcggcuccugcccaguccgacgucgcccuccugcgguuugugaaucccgauacaggcagagugcuuuucgaauguaagcugcacaaaagcggguacgucaccguggcucauacgggacagcacgaccucguuauuccgccuaacggcuauuuucgcuucgauucuugggugaaccaauucuacacccuggcccccauggggaauggcacaggacggagacgcgcugucuga

SEQ ID NO: 28230 - RNA, 1623 nt, Artificial Sequence
  derived and/or modified sequence opt5 from capsid_protein__Norovirus__AHC12655
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguccaccgucagcugcagagugcugacccggccuucuccggauuucgacuuuauuuuccucguucccccuacaguggaaucccgcaccaaacccuuuagcgucccugugcugacgguugaggaaaugaccaauucuagauuccccaucccgcuugagaagcuguuuacagggccuuccagcgccuucgugguccagccccagaacggacgguguaccacagauggcgugcuccuggggaccacgcaacugucuccugucaauauuugcacauuccgcggagacgugacccauaucacaggcuccagaaacuacaccaugaaucucgcuagccagaacuggaauaacuaugaucccaccgaggaaauuccugcgccccugggcacaccggacuuuguugggaaaauccagggaaugcuuacgcagaccacacggaccgacggcuccacacgcgggcacaaggccaccguguacacgggaucugcugauuucgccccuaagcugggcagaguccaauuugagacagacaccgaucaugacuucgaagccaaucagaacaccaaauuuacacccaucggggugauucaggauggaagcaccacacaccggaaugagccccaacaguggguucucccuuccuacagcggccgcaacacgcacaaugugcaucuggcuccggccgucgcgcccaccuucccuggcgaacagcuucuguuuuucagaucuacaaugcccggguguuccggauauccuaacauggaccucgauugccugcugccccaggagugggugcaauacuuuuaucaggaggcugccccugcccagagcgacguggcucuccugcgguucguuaaucccgauaccggcagaguccuuuuugaauguaagcugcacaaaucuggguacgugacaguggcccauaccggacagcacgaccucgucaucccgccuaacggcuauuuccgcuuugauagcugggugaaccaauucuacacgcuggcucccauggggaauggcaccggacggagacgcguuguguga

SEQ ID NO: 28231 - RNA, 1623 nt, Artificial Sequence
  derived and/or modified sequence opt5 from capsid_protein__Norovirus__AHC12658
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcuaucccucccaauuuuccuacggagggacugucccccucucaggugaccauguucccgcauaucgucguggacgugagacaacucgagccuguccugauuccccugccugauguucggaacaauuuuuaucacuacaaccagagcaaugaccccacaaucaagcucauugccaugcuguauacaccccuucgcgcuaacaacgccggcggggauguguucaccguguccugcagaguccugacccggccuagcccggacuuugauuucaucuuucucgugcccccuacaguugaaucucgcaccaaacccuucuccgugccuguccugacgguggaggaaaugaccaauagcagauuucccauuccgcuugagaagcuguucacaggaccuucuuccgccuucguugugcagccccagaacggccgguguaccacagacgggguccuccugggaaccacgcaacugagcccugugaauaucugcacauuucgcggcgaugucacccauauuacaggcucuagaaacuacaccaugaaucucgcuucccagaacuggaauaacuaugaccccaccgaggaaaucccugcgccccuggggacaccggauuucgugggaaaaauccagggcaugcuuacgcagaccacacggaccgacgggagcacacgcggacacaaggccaccguuuacacgggcuccgcugacuuugccccuaagcuggggagagugcaauucgagacagauaccgaccaugauuuugaagccaaucagauuaccaaauucacacccaucggagucauucaggacggcucuaccacacaccggaacgagccccaacagugggugcucccuagcuacuccggccgcaauacgcacaacguucaucuggcuccggccguggcgcccaccuuuccuggggaacagcuucuguucuuuagaagcacaaugcccggauguucuggcuauccuaauauggaucucgacugccugcugccccaggaguggguccaauacuucuaucaggaggcugccccugcccaguccgauguggcucuccugcgguuugugaaccccgacaccgggagaguucuuuucgaauguaagcugcacaaaagcggauacgucacaguggcccauaccggccagcacgaucucgugaucccgccuaauggguauuuucgcuucgacucuugggucaaccaauucuacacgcuggcucccaugggcaacggaaccggccggagacgcgugguuuga

SEQ ID NO: 28232 - RNA, 1632 nt, Artificial Sequence
  derived and/or modified sequence opt5 from capsid_protein__Norovirus__AHW99832
augaugauggccagcaaggacgcucccuccucugccgauggcgcgaacggggcuggacagcuggugccugaggucaauaacgccgaaccgcucccccuggacccuguugccggcgcuagcaccgcccuugcuacagccgggcaagugaauaugaucgaucccuggauuuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauuaucugcugugucccucccggauuccagagccgcacccuguccaucgcccaggcgacacucuuuccucacauuaucgccgacgugagaacccuggaacccauugagaucccgcuugaagauguucggaacacacuguaucauaccaaugacaaccagccuacgaugcgccuccugugcaugcuuuacacaccccugagaaccggcgggggaucuggcgggaccgaugcuuucguggucgccggacgggugcucacauguccuagcuccgacuuuaauuuccuguuucuggugccucccaccgucgagcaaaagacgcgccccuucagcguuccgaacauuccccuccagcugcuuucuaacuccagagugccuaaucugauccagagcauggugcucucucccgaucaggcucaaaacguccaguuucagaauggccggugcacaaccgacggccaacugcuugggacaaccccuguguccguuagccagauucugaaauuccgcggaaaggugucugccggcuccaaagucaucaaccucaccgagcuggaugggagccccuuccuggccuuugaagcuccggcgccuacaggauuccccgaccucggcacguccgacuggcacguggagaugucucugaauagcaacucccagagcucugggaauccuauccuucugagagauauucaucccaacuccagcgaauuuguuccucaccucggaucugugugugucaccgccgcuaucgagguggccggcgacuauacaggcaccauucaguggacaagccaacccuccaaugucaccccggugccugauguuaacuucuggacgaucccccacuacgggucuaaucuggccgaggcuagccagcuugcccccguggucuauccuccgggauuuggcgaagcgauuguguacuucaugucccccaucccugggcccaacacagcucauaagccuaaucugguucccugccuccugccucaggaguuugugacccacuucgucagcgaacaggcccccucuaugggagaggccgcucuggugcauuauguggacccggauaccaaccggaaucucggcgaauuuaagcuguacccugagggguucaucacauguguucccaacggcaccggaccucaacagcuuccccugaacggcgucuuuguguucgccuccugggugagccgcuuuuaccagcucaaaccggucgggacagcuucuuccgccagaggacggcugggcgugcgcagauga

SEQ ID NO: 28233 - RNA, 1647 nt, Artificial Sequence
  derived and/or modified sequence opt5 from capsid_protein__Norovirus__AHZ12735
augaagauggccagcaacgacgcuacccccuccaaugauggcgccgcggggcuggugccugagaucaacaaugaagcuauggcccucgagccggucgccggagcugccauugcugcgccccugacaggccagcaaaacaucauugacccuuggaucaugaauaacuucguucaggcccccgggggagaauuuacggugucuccuagaaauagccccggcgaggugcuucugaaccucgaacuggggcaggagauuaauccuuaccuugcccaccuggcucggauguauaacggauacgccggcggcuucgagguccaggugguucucgcugggaaugccuuuaccgcgggaaaaaucaucuucgccgcuauuccgcccaacuuuccuaucgauaaucuguccgccgcucaaauuacaaugugcccccaugugaucgucgacgugcgccagcuggaaccuguuaaccuccccaugccggaugugagaaauaacuucuuucacuauaaccagggcucugacagccggcugcgccuugucgccaugcuguacaccccucucagagccaauaacuccggggaugacguguucacagugucuugucggguccugacccgccccagcccugaguuuuccuucaauuuucuuguuccucccacaguggaaagcaagaccaaacccuucacgcugccgauucucaccaucucugagauguccaacagcagauuucccgugccuauugauucucugcauacaucccccaccgagaauaucgucgugcagugccaaaacggacggguuacacuggacggcgaacucauggggaccacgcagcugcuuccuagccagaucugugcuuuccgcggagugcugacaagaucuaccucccggacaagcgaucaggcggacaccgccacaccccgccucuucaauuauuacuggcacauucaacuggauaaccuuaauggcaccccguaugacccugcugaggacauccccggcccucuggggacgcccgauuuuagaggaaaggucuucggcguggccucccagcggaacccugacucuaccacacgcgcccaugaagcuaaaguugauaccacagccgggagauuuacccccaagcucggaagccuggagauuuccacggaaagcggcgacuucgaucagaaucaaccgacacgguuuaccccuguggggaucggagucgacagagaggcggauuuccagcaguggucucugcccgacuacuccggccaguuuacccacaacaugaaucucgcucccgccguggccccuaacuucccgggcgagcaacugcuguuuuuccgcagccagcuucccucuagcgggggacgguccaauggcauucucgauugccuggucccucaggaaugggugcagcacuuuuaccaagagucugcucccgcccagacacagguugcucuugugagauaugucaacccugacaccgggcgcgugcuguucgaagccaagcuccauaaacugggauuuaugacaaucgcgaagaacggcgauagccccaucacgguuccucccaauggguacuuccgguucgaguccugggugaacccguuuuauacccuggccccuaugggcacaggaaauggcagacgccggguccaguga

SEQ ID NO: 28234 - RNA, 1647 nt, Artificial Sequence
  derived and/or modified sequence opt5 from capsid_protein__Norovirus__AHZ12736
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgaauuuuccuucaauuuucuuguucccccuacaguggagagcaagaccaaaccguucacgcugcccauucucaccaucucugaaauguccaacagcagauuuccugugcccauugacucucugcauacauccccuaccgagaauaucgucgugcagugccagaacggacggguuacacuggauggcgagcucauggggaccacgcaacugcuucccagccagaucugugcuuuccgcggagugcugacaagaucuaccucccgggcgagcgaccaggccgauacagcuaccccgcgccucuucaauuauuacuggcacauucagcuggacaaccuuaauggcaccccuuaugaccccgccgaagauaucccuggcccccuggggacaccugacuuuagaggaaaggucuucggcguggccucccaacggaaccccgauaauacgacccgcgcucaugaggccaaaguugacacaaccgcggggagauuuacaccgaagcucggaucucuggaaauuagcaccgaguccggcgauuucgaccagaaccagccuacgcgguuuacacccguggggaucggagucgaucacgaagcugacuuccaacaguggagccugcccgauuacucuggccaguuuacccacaauaugaaccucgccccugccguggcuccgaauuuccccggcgagcagcugcuguuuuucagaucccaacuuccuagcucugggggacgcagcaacggcauucucgacugccuggucccccaggagugggugcagcauuuuuaccaggaauccgccccugcucaaacccagguugcccuugugcgguaugucaaccccgauacagggagagugcuguucgaggcgaagcuccacaaacugggauuuaugaccaucgccaagaauggcgacucuccuaucacaguucccccgaacggguacuuccgcuucgaaagcugggugaauccuuuuuauacgcuggcucccaugggcaccggaaacggccggagacgcguccaguga

SEQ ID NO: 28235 - RNA, 1647 nt, Artificial Sequence
  derived and/or modified sequence opt5 from capsid_protein__Norovirus__AHZ12737
augaagauggccagcaacgacgcugcccccuccaaugauggcgcggcugggcuggugccugagaucaacucugaagccauggcccucgagccggucgcuggagccgcuauugccgcgccccugaccggccagcaaaauaucauugacccuuggaucaugaacaauuucguucaggcccccgggggagaauuuacagugagcccuagaaacucccccggcgaggugcuucugaaucucgaacuggggccugagauuaacccguaccuugcucaccuggcccggauguauaauggauacgcuggcggcuucgagguccaggugguucucgccgggaacgcguuuacggccggaaaaaucaucuucgcugccauucccccuaauuuucccaucgauaaccugucugcugcccagauuaccaugugcccucaugugaucgucgacgugcgccaacuggaacccguuaaucucccgaugccugaugugagaaacaauuucuuucacuauaaccagggcagcgacucccggcugcgccuuauugccaugcuguacacaccccucagagcuaacaauucuggggaugacgucuucaccgugagcugucgggugcugacacgcccuucccccgauuuuagcuucaacuuucuuguucccccuaccgucgagucuaagacaaaaccguucucccugcccauccucaccauuagcgaaaugucuaauuccagauuuccugugcccaucgacagccugcauacgucuccuaccgagaacaucgugguccagugccagaauggacgggugacacuggauggcgagcucauggggaccacacaacugcuucccucccagauuugugcguuccgcggaacccugacgagaagcacaucccgggccucugaccaggcugauaccgccacaccgcgccucuucaacuauuacuggcacauccagcuggacaaucuuaacggcaccccuuaugaccccgccgaagauauuccuggcccccuggggaccccugacuuuagaggaaagguuuucggcguggcuagccaacggaaucccgaugccacaacgcgcgcgcaugaggcuaaaaucgacaccacauccgggagauuuaccccgaagcucggaagccuggaaauuucuacagaguccgaugacuucgaucagaaccagccuacccgguuuacgcccgucggcguggggguugaccacgaacccgauuuccaacagugggugcugccugacuacgccggacaguuuacacacaauaugaaccucgccccggcugucgcccccaauuucccuggcgagcagcugcuguuuuucagaagccaacuucccucuagcggcgggcgcuccaacggaauccucgauugccuggugccucaggaguggguccagcauuuuuaccaggaaucugcucccagccaaacccagguggcccuuguucgguaugugaauccugacaccggcagaguccuguucgaggcgaagcuccacaaacugggguuuaugacaaucgccaaguccggagacagccccauuaccgugccgccuaacggcuacuuccgcuucgaaucuuggguuaaccccuuuuauacacuggcuccuauggggacgggcaauggacggagacgcauccaguga

SEQ ID NO: 28236 - RNA, 1647 nt, Artificial Sequence
  derived and/or modified sequence opt5 from capsid_protein__Norovirus__AHZ12738
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgaauuuuccuucaauuuucuuguucccccuacaguggagagcaagaccaaaccguucacgcugcccauucucaccaucucugaaauguccaacagcagauuuccugugcccauugacucucugcauacauccccuaccgagaauaucgucgugcagugccagaacggacggguuacacuggauggcgagcucauggggaccacgcaacugcuucccagccagaucugugcuuuccgcggagugcugacaagaucuaccucccgggcgagcgaccaggccgauacagcuaccccgcgccucuucaauuauuacuggcacauucagcuggacaaccuuaauggcaccccuuaugaccccgccgaagauaucccuggcccccuggggacaccugacuuuagaggaaaggucuucggcguggccucccaacggaaccccgauucuacgacccgcgcucaugaggccaaaguugacacaaccgcggggagauuuacaccgaagcucggaagccuggaaauuuccaccgagagcggcgauuucgaccagaaucagccuacgcgguuuacacccguggggaucggagucgaucacgaagcugacuuccaacaguggucucugcccgauuacuccggccaguuuacccacaacaugaaucucgccccugccguggcuccgaacuuccccggcgagcagcugcuguuuuucagaagccaacuuccuucuagcgggggacgcuccaauggcauucucgacugccuggucccccaggagugggugcagcauuuuuaccaggaaucugccccugcucaaacccagguugcccuugugcgguaugucaaccccgauacagggagagugcuguucgaggcgaagcuccacaaacugggauuuaugaccaucgccaagaacggcgacagcccuaucacaguucccccgaauggguacuuccgcuucgaauccugggugaacccuuuuuauacgcuggcucccaugggcaccggaaauggccggagacgcguccaguga

SEQ ID NO: 28237 - RNA, 1647 nt, Artificial Sequence
  derived and/or modified sequence opt5 from capsid_protein__Norovirus__AHZ12739
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuugucgccaugcuguacacaccccucagagccaauaacuccggggacgauguguucaccgugucuugucggguccugacccgcccuagccccgaauuuuccuucaauuuucuuguucccccuacaguggagagcaagaccaaaccguucacgcugcccauucucaccaucucugaaauguccaacagcagauuuccugugcccauugacucucugcauacauccccuaccgagaauaucgucgugcagugccagaacggacggguuacacuggauggcgagcucauggggaccacgcaacugcuucccagccagaucugugcuuuccgcggagugcugacaagaucuaccucccggacaagcgaccaggcggauaccgccaccccgcgccucuucaauuauuacuggcacauucagcuggacaaccuuaauggcacaccuuaugaccccgcugaagauaucccuggcccccuggggacgccugacuuuagaggaaaggucuucggcguggccucccaacggaaccccgauucuaccacacgcgcccaugaggcuaaaguugacaccacagccgggagauuuaccccgaagcucggaagccuggaaauuuccacggagagcggcgauuucgaccagaaucagccuacacgguuuacccccguggggaucggagucgaucacgaagcggacuuccaacaguggucucugcccgauuacuccggccaguuuacccacaacaugaaucucgcuccugccguggccccgaacuuccccggcgagcagcugcuguuuuucagaagccaacuuccuucuagcgggggacgcuccaauggcauucucgacugccuggucccccaggagugggugcagcauuuuuaccaggaaucugcuccugcccaaacacagguugcucuugugcgguaugucaaccccgauaccgggagagugcuguucgaggccaagcuccacaaacugggauuuaugacaaucgcgaagaacggcgacagcccuaucacgguucccccgaauggguacuuccgcuucgaauccugggugaacccuuuuuauacccuggcccccaugggcacaggaaauggccggagacgcguccaguga

SEQ ID NO: 28238 - RNA, 1623 nt, Artificial Sequence
  derived and/or modified sequence opt5 from capsid_protein__Norovirus__AHZ12912
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucuccauuugcaccuuucgcggagacgugacacauaucccuggcagccacaauuacaccaugaaccucgccucccagaauuggaacucuuaugaucccaccgaggaaaucccugcuccccugggcacaccggacuucgucgggaaaauucagggagugcuuacgcagaccacaagaaccaauggcagcacacgggggcauaaggcgaccguuuacacgggauccgccgacuuuagcccuaagcugggccgcgugcaauucgcuacagauaccaacaaugacuuugagaccaaccagaauacaaaauucacccccgucggggugauccaggauggaucuacaacgcccagaaacgaaccucaacaguggguucucccguccuacagcggccggaauauucacaacgugcaccuggcccccgccgucgcuccuaccuuucccggcgagcagcuucuguucuuucgcucuacaaugccuggguguagcggauaucccaauauggaccucgauugccugcugccucaggaaugggugcaauacuucuaucaggaggccgcgcccgcucaguccgacguggcccuccugagauuuguuaacccggauaccggccggguccuuuucgaguguaagcugcauaaaucuggguacgugacaguggcccacaccggacagcaugaccucgucaucccucccaacggcuauuuuagauucgauagcugggugaaucaauucuacacgcuggcuccuauggggaacggcaccggacgccggagagcccuuuga

SEQ ID NO: 28239 - RNA, 1623 nt, Artificial Sequence; identical to SEQ ID NO: 28238
  derived and/or modified sequence opt5 from capsid_protein__Norovirus__AHZ12913

SEQ ID NO: 28240 - RNA, 1623 nt, Artificial Sequence
  derived and/or modified sequence opt5 from capsid_protein__Norovirus__AHZ12998
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugauccauaucucuggcuccagaaacuacacaaugaaucucgccagccagaacuggaacuccuaugaucccaccgaggaaauuccugcuccccugggcaccccggacuucgucgggaaaauccagggagugcuuacacagacgacccggacaaauggcucuacccgcgggcacaaggcgacaguuuacaccggaagcgccgacuuuuccccuaagcugggcagagugcaauucgcuacggauacagacaaugauuuugagaccaaccagaauaccaaauucacacccgucggggugauucaggacggaagcaccacaccccggaacgaaccucaacaguggguucucccgucuuacuccggccgcaauauccauaacgugcaccuggcccccgccgucgcuccuacguuucccggcgagcagcuucuguucuuuagaagcaccaugccuggguguucuggauaucccaauauggaucucgacugccugcugccucaggaaugggugcaauacuucuaucaggaggccgcgcccgcucagagcgauguggcccuccugcgguuuguuaacccggacacaggcagaguccuuuucgaguguaagcugcacaaauccggguacgugaccguggcccauacaggacagcacgaucucgucauuccucccaacggcuauuuucgcuucgacucuugggugaaucaauucuacacccuggcuccuauggggaacggcacgggacggagacgcgcccuuuga

SEQ ID NO: 28241 - RNA, 1623 nt, Artificial Sequence; identical to SEQ ID NO: 28240
  derived and/or modified sequence opt5 from capsid_protein__Norovirus__AHZ13001

SEQ ID NO: 28242 - RNA, 1623 nt, Artificial Sequence; identical to SEQ ID NO: 28240
  derived and/or modified sequence opt5 from capsid_protein__Norovirus__AHZ13004

SEQ ID NO: 28243 - RNA, 1623 nt, Artificial Sequence; identical to SEQ ID NO: 28240
  derived and/or modified sequence opt5 from capsid_protein__Norovirus__AHZ13010

SEQ ID NO: 28244 - RNA, 1623 nt, Artificial Sequence; identical to SEQ ID NO: 28240
  derived and/or modified sequence opt5 from capsid_protein__Norovirus__AHZ13015

SEQ ID NO: 28245 - RNA, 1623 nt, Artificial Sequence; identical to SEQ ID NO: 28240
  derived and/or modified sequence opt5 from capsid_protein__Norovirus__AHZ13020

SEQ ID NO: 28246 - RNA, 1623 nt, Artificial Sequence; identical to SEQ ID NO: 28240
  derived and/or modified sequence opt5 from capsid_protein__Norovirus__AHZ13023

SEQ ID NO: 28247 - RNA, 1545 nt, Artificial Sequence
  derived and/or modified sequence opt5 from capsid_protein__Norovirus__AIC32559
auggcccuggagcccguggucggcgcugccaucgcggcuccuguugccgggcagcaaaacgugauugacccguggaucagaaauaacuucgugcaggcccccggaggcgaauuuaccgucagcccucggaaugcucccggggagauucucugguccgccccucugggacccgaucuuaacccuuaccugucucaccucgcucgcauguauaauggcuacgccgggggauucgaagugcagguuauccuggcgggcaacgccuuuacagcuggcaaggugauuuucgccgcugucccgcccaauuuuccuacggaggggcuuagccccucccaggugaccauguucccucauaucguuguggacgucagacaacuggaacccgugcucaucccgcugccugaugugcggaacaauuuuuaucacuacaaccagucuaaugaccccacaauuaaacugaucgccaugcucuauaccccucugcgcgcgaacaaugccggagaugacgucuucacaguuagcugcagagugcuuacccggcccucccccgauuuugacuucauuuuucuggugccuccgacagucgagucucgcaccaagcccuucagcgugccuguucucacgguggaggaaaugaccaacuccagauuucccaucccucuggagaaacuuuucacaggccccagcucugcuuucgucgugcagccgcagaaugggcgguguaccacagauggaguucugcucggcaccacgcaacuguccccugugaacauuugcacauuucgcggggacgucacccauaucacaggaagcagaaacuacaccaugaaucuggccucucagaacuggaauaacuaugaucccaccgaagagauuccugcuccccucggcgccccugacuucgugggcaagauccaggggaugcugacacagacgacccgggccgauggauccacacgcggccacaaagcuaccgucuacacagggagcgcggacuuugcccccaagcugggaagagugcaauucgagaccgacacggaucaugacuuugaagcuaaucagaacacaaaguucaccccgguuggcgugauccaggaugggucuaccacacaccggaaugagccucaacaguggguccuucccuccuacagcggacgcaacacccacaaugugcaucucgcccccgccguugcuccuacauuuccgggcgaacagcugcuuuucuuuagauccacgaugcccggcuguucuggguauccuaacauggaccuggauugccuccugccccaggagugggugcaauacuucuaucaggaagccgcgccugcucagagcgacgucgcccugcuccgguuugugaaucccgauaccggaagagugcuguucgaguguaaacuucacaaguccggcuacguuacagucgcccauaccgggcagcacgaccuggugauuccucccaacggauauuuucgcuucgauagcugggugaaucaauucuacacacucgcuccgaugggcaacggggccggccggagacgcgucguguga

SEQ ID NO: 28248 - RNA, 1617 nt, Artificial Sequence
  derived and/or modified sequence opt5 from capsid_protein__Norovirus__AID51474
auggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaagaucauuuuugccgcggugcccccuuauuuccccgucgaaaaccugagcccuucccagaucacaauguuuccccauguuaucauugaugugagaacccuggagccgguccuccugccuaugcccgacgugcggucuacacuuuuccacuuuaaucagaaagaugaaccuaagaugcgccugguggccaugcucuacacgccccugagaagcaacggauccggcgacgaugucuucaccguuagcugccggauccuuacccgccccucuccugaguuugacuucacauaucuggugccgcccaccguggaguccaaaacaaagccuuuuacccuccccguccugacgcugggggaacucagcaauucuagauucccucuguccauugaugagauggugacaagccccaacgaaucuaucguugugcaaccgcagaacggacgggucacccuugacggcgagcugcucgggacaacccagcugcaggcuuguaauauuugcuccauccgcggaaaagugaccggccaaguuccuaacgaacagcauauguggaaucuugagauuacaaaccugaauggcacgcaguuugaucccaccgacgaugugccugcuccccucggggucccugacuucgccggagagguguucggcguccugagccagagaaaccgcggggaauccaaucccgccaaccgggcccacgacgcugugguugcgacauacucugauaaguauaccccgaagcugggacucgugcaaaucggcacauggaauaccaacgacgucgagaaucagccuacgaaauuuacacccaucgggcugaacgaaguggccaauggacauagauucgagcaguggacccuuccccgguacagcggcgcucugacccucaacaugaaucuggccccugccguugcuccgcuuuuucccggcgaacgccuccuguucuuuagauccuacgugccucugaaagggggauucggcaaccccgccauugauugucuggucccucaagagugggugcagcacuuuuaucaggagagcgcgcccucucucggggacguggcucugguucgguacgucaacccugauacaggaagagugcuuuucgaagccaagcugcacaagggcggguuucucaccguguccagcacaucuacgggccccgucgugguuccggccaauggauauuuccgcuuugacagcugggugaaccaguucuacucccuggcuccuaugggcaccgggaauggacggagacgcuuucaauga

SEQ ID NO: 28249 - RNA, 1617 nt, Artificial Sequence; identical to SEQ ID NO: 28248
  derived and/or modified sequence opt5 from capsid_protein__Norovirus__AID51477

SEQ ID NO: 28250 - RNA, 1617 nt, Artificial Sequence; identical to SEQ ID NO: 28248
  derived and/or modified sequence opt5 from capsid_protein__Norovirus__AID51480

SEQ ID NO: 28251 - RNA, 1617 nt, Artificial Sequence; identical to SEQ ID NO: 28248
  derived and/or modified sequence opt5 from capsid_protein__Norovirus__AID51483

SEQ ID NO: 28252 - RNA, 1617 nt, Artificial Sequence; identical to SEQ ID NO: 28248
  derived and/or modified sequence opt5 from capsid_protein__Norovirus__AID51486

SEQ ID NO: 28253 - RNA, 1617 nt, Artificial Sequence; identical to SEQ ID NO: 28248
  derived and/or modified sequence opt5 from capsid_protein__Norovirus__AID51489

SEQ ID NO: 28254 - RNA, 1617 nt, Artificial Sequence; identical to SEQ ID NO: 28248
  derived and/or modified sequence opt5 from capsid_protein__Norovirus__AID51492

SEQ ID NO: 28255 - RNA, 1617 nt, Artificial Sequence; identical to SEQ ID NO: 28248
  derived and/or modified sequence opt5 from capsid_protein__Norovirus__AID51495

SEQ ID NO: 28256 - RNA, 1623 nt, Artificial Sequence
  derived and/or modified sequence opt5 from capsid_protein__Norovirus__AIE40036
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucuccguucccgugcugacgaucgaggaaaugaccaacagcagauuuccuauuccccuugagaagcuguucacagggccgucuuccgccuucgucgugcagccucagaauggacgguguaccacagauggcguucuccuggggaccacgcaacugagccccgugaacaucugcacauuucgcggagacgucacccauaucacaggcucuagaaauuacaccaugaaccucgcuucccagaauuggaacaauuaugauccuaccgaggaaauucccgcgccucugggcacacccgacuucguggggaaaauccagggaaugcuuacgcagaccacacggaccgacggcagcacacgcgggcacaaggccaccgucuacacgggauccgcugauuuugccccgaagcugggcagagugcaauucgagacagacaccgaucaugacuuugaagccaaccagaauaccaaauucacaccuauugggguuauccaggauggaucuaccacacaccggaacgagccccaacagugggugcuccccagcuacuccggccgcaauacgcacaacguccaucuggcuccugccguggcgccgaccuuucccggcgaacagcuucuguucuuuagaagcacaaugccuggguguucuggauaucccaauauggaccucgauugccugcugccucaggaguggguucaauacuucuaucaggaggcugcccccgcccaguccgacguggcucuccugcgguuugucaacccugauaccggcagagugcuuuucgaauguaagcugcacaaaagcggguacgugacaguugcccauaccggacagcacgaccucgucauucccccgaacggcuauuuucgcuucgauucuugggugaaucaauucuacacgcuggcuccuauggggaacggcaccggacggagacgcgcccuuuga

SEQ ID NO: 28257 - RNA, 1647 nt, Artificial Sequence
  derived and/or modified sequence opt5 from capsid_protein__Norovirus__AJW87644
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaucagauccaccagccgggccuccgaccaggcugauacggccacaccgcgccucuucaauuauuacuggcacauucagcuggacaaccuuaauggcaccccuuaugaccccgccgaagauaucccuggcccccuggggacaccugacuuuagaggaaagguguucggcgucgcuucucaacggaaccccgauaccaccacacgcgcccaugaggcgaaaauugacacgaccagcgggagauuuacaccgaagcucggaucccuggaaaucagcaccgagucugaugacuucgaucagaauaagccuacacgguuuacccccgugggcaucgggguugaccacgaagcugauuuccagcaauggacgcugcccgacuacgccggacaguuuacacacaacaugaaucucgccccugcuguggccccgaacuuccccggcgagcagcugcuguuuuucagaucccagcuuccuagcucuggcgggcgcagcaauggcauucucgauugccuggucccccaagagugggugcagcauuuuuaccaggaauccgcuccuucucagagccaagucgcccuugugcgguauaucaaccccgacaccggaagaguucuguucgaggcgaaacuccacaagcugggguuuauuaccaucgccaaaaacggagacuccccuauuacagugcccccgaauggcuacuuccgcuucgaaagcugggucaacccuuuuuauacccuggcucccauggggacaggcaauggacggagacgcauccaguga

SEQ ID NO: 28258 - RNA, 1623 nt, Artificial Sequence
  derived and/or modified sequence opt5 from capsid_protein__Norovirus__ALG05457
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuguccccggaucuuaaccccuaccuggcgcaccucucucgcauguauaauggguacgccggaggcgucgaggugcagguucugcuggcuggcaacgccuucacagcugggaaaauucucuuugccgcggugccucccaauuucccugucgaguuucugagccccgcccagaucaccaugcuuccgcaucugaucguggacguuagaacacucgaaccuauuaugaucccccugccugaugugcggaacaccuucuuucacuauuccaaucagcccaacucucgcaugagacuugucgcuaugcuguacacaccccuccggagcaacggauccggcgacgauguguucaccgugagcugccgcguccugacgagaccuaccccggacuuugaguucacauaucugguucccccuucuguggaauccaagaccaaacccuuuagccucccuauucugacacuuucugagcugaccaauucccgguuccccgugccgaucgauagccucuuuacggcccaaaacaauguccuucaggugcagugucagaacgggcgcugcacacuugacggagagcugcaaggcaccacacagcuccugccuucugggauuugugcuuucagaggacggguuaccgcccagaucaaucagcgcgauagauggcauaugcaacugcagaaccucaauggcaccacauacgaccccacggaugacgugccugcuccccugggcaccccugacuucaagggggucguguuuggaaugguuucccagcggaacgugggcaaugaugcccccgggagcacacgcgcgcaacaggccugggucuccaccuauucuccgcaguucgugccuaaacuuggaagcgucaaccugagaauuuccgacaaugaugacuuucaguuccaacccacaaaguuuacccccgugggcguuaacgaugacgaugacgggcacccuuuccggcagugggaacucccgaauuacagcggagagcugacgcuuaacaugaaucuggcucccccuguggcccccaacuuuccuggcgaacagcuccuguucuuuagaucuuucguccccugcuccggcggguacaaccagggaaucaucgauugucugauuccucaagaguggauccagcauuuuuaucaggaaagcgcccccucucagagcgacguggcucucauucgcuacguuaauccggauacaggccggacccuguucgaggccaagcugcacagauccggguauaucaccguggcgcacucuggagacuacccucuggucgugcccgcuaacggccauuuucgcuucgacagcugggugaaucaauucuauucccucgccccuauggggacaggcaacggacggagacgcgcccaguga

SEQ ID NO: 28259 - RNA, 1623 nt, Artificial Sequence
  derived and/or modified sequence opt5 from capsid_protein__Norovirus__ALG05460
augaagauggccagcaacgacgcugcccccuccaaugauggcgcggcugggcuggugccugagggaaacgacgaaacccucccgcuggagcccgucgccggcgccgcuaucgccgcuccuguuacagggcagaauaacauuaucgaucccuggauuagaacgaauuucgugcaagccccuaacggagaauuuaccgugucuccccggaauagcccuggcgagauccuucugaaccucgaacuggggccggaccuuaaucccuaccuggcgcaccucucccgcauguauaacggauacgccggcggcgucgaggugcagguucugcuggcugggaaugccuucacagcuggaaaaauucucuuugccgcggugccucccaacuucccugucgaguuucugucucccgcccagaucaccaugcuuccgcaucugaucguggauguuagaacacucgaaccuauuaugaucccccugccugacgugcggaauaccuucuuucacugcagcaaccagcccaauucccgcaugagacuugucgcuaugcuguauacaccccuccggucuaacggcagcggggaugacguguucaccguguccugucgcguccugacgagaccuaccccggauuuugaguucacauaccugguucccccuagcguggaaucuaagaccaaacccuuuucccucccuauucugacacuuagcgagcugaccaacucucgguuccccgugccgaucgacucccucuuuacggcccaaaauaacguccuucaggugcagugccagaauggacgcuguacacuugauggcgagcugcaagggaccacacagcuccugccuagcggaauuugcgcuuucagaggccggguuaccgcccagaucaaccagcgcgacagauggcauaugcaacugcagaaucucaacggcaccacauaugaucccacggacgacgugccugcuccccuggggaccccugauuucaagggagucguguuuggcaugguuucucagcggaauguggggaacgacgcccccggauccacacgcgcgcaacaggccugggucagcaccuacuccccgcaguucgugccuaaacuuggcucugucaaucugagaauuagcgauaacgacgauuuucaguuccaacccacacaguuuacccccguggggguuaaugacgaugacgauggacacccuuuccggcagugggaacucccgaacuauuccggcgagcugacgcuuaauaugaaccuggcucccccuguggcccccaauuuuccuggcgaacagcuccuguucuuucgcagcuucguccccuguucugggggauacaaccaaggcaucaucgacugccugauuccucaggaguggauccagcauuuuuaccaggaauccgcccccagccaaucugauguggcucucauuagauauguuaacccggacacagggcggacccuguucgaggccaagcugcacagaagcggauacaucaccguggcgcacuccggcgacuauccucuggucgugcccgcuaaugggcauuuucgcuucgauucuugggugaaccaguucuacagccucgccccuaugggcacaggaaauggccggagacgcgcccaguga

SEQ ID NO: 28260 - RNA, 1623 nt, Artificial Sequence
  derived and/or modified sequence opt5 from capsid_protein__Norovirus__ALL73873
augaagauggccagcaacgacgcugcccccuccaaugauggcgcggcugggcuggugccugagggaaacaaugaaacccucccgcuggagcccgucgccggcgccgcuaucgccgcuccuguuacagggcagaacaauauuaucgaccccuggauuagaacgaacuucgugcaagccccuaauggagaauuuaccgugucuccccggaacagcccuggcgagauccuucugaaucucgaacuggggccggaucuuaaccccuaccuggcgcaccucucccgcauguauaauggauacgccggcggcgucgaggugcagguucugcuggcugggaacgccuucacagcuggaaaaauucucuuugccgcggugccucccaauuucccugucgaguuucugucucccgcccagaucaccaugcuuccgcaucugaucguggacguuagaacacucgaaccuauuaugaucccccugccugaugugcggaacaccuucuuucacuauagcaaucagcccaacucccgcaugagacuugucgcuaugcuguacacaccccuccggucuaacggcagcggggacgauguguucaccguguccugccgcguccugacgagaccuaccccggacuuugaguucacauaucugguucccccuagcguggaaucuaagaccaaacccuuuucccucccuauucugacacuuagcgagcugaccaauucucgguuccccgugccgaucgauucccucuuuacggcccaaaacaauguccuucaggugcagugucagaacggacgcugcacacuugacggcgagcugcaagggaccacacagcuccugccuagcggaauuugugcuuucagaggccggguuaccgcccagaucaaucagcgcgauagauggcauaugcaacugcagaaccucaauggcaccacauacgaccccacggaugacgugccugcuccccuggggaccccugacuucaagggagucguguuuggcaugguuucucagcggaacgugggguccgaugcccccggaagcacacgcgcgcaacaggccugggucuccaccuauucuccgcaguucgugccuaaacuuggcagcgucaaucugagaauuuccgacaacgaugacuuucaguuccaacccacaaaguuuacccccguggggguuaaugaugacgaugacggacacccuuuccggcagugggaacucccgaacuacagcggcgagcugacgcuuaauaugaaccuggcucccccuguggcccccaauuuuccuggcgaacagcuccuguucuuuagaucuuucguccccugcuccgggggauacaaccagggcaucaucgauugucugauuccucaagaguggauccagcauuuuuaucaggaaagcgcccccucucagagcgacguggcucucauucgcuacguuaacccggauacagggcggacccuguucgaggccaagcugcacagauccggauauaucaccguggcgcacucuggcgacuacccucuggucgugcccgcuaaugggcauuuucgcuucgacagcugggugaaccaauucuauucccucgccccuaugggcacaggaaauggccggagacgcgcccaguga

SEQ ID NO: 28261 - RNA, 1623 nt, Artificial Sequence; identical to SEQ ID NO: 27460
  derived and/or modified sequence opt5 from capsid_protein__Norovirus__ALL73876

SEQ ID NO: 28262 - RNA, 1623 nt, Artificial Sequence
  derived and/or modified sequence opt5 from capsid_protein__Norovirus__ALL73879
augaagauggccagcaacgacgcugcccccuccaaugauggcgcggcugggcuggugccugagggaaacaaugaaacccucccgcuggagcccgucgccggcgccgcuaucgccgcuucuguuacagggcagaacaauauuaucgacccuuggauuagaacgaacuucgugcaagcccccaauggagaauuuaccgugagcccucggaacucccccggcgagauccuucugaaucucgaacuggggccugaucuuaacccguaccuggcgcaccucucucgcauguauaauggauacgccggcggcgucgaggugcagguucugcuggcugggaacgccuucacagcuggaaaaauucucuuugccgcggugcccccuaauuuccccgucgaguuucugagcccugcccagaucaccaugcuuccccaucugaucguggacguuagaacacucgaaccgauuaugaucccucugcccgaugugcggaacaccuucuuucacuauuccaaucagccuaacucucgcaugagacuugucgcuaugcuguacacaccccuccggagcaacggcuccggggacgauguguucaccgugagcugccgcguccugacgagacccaccccugacuuugaguucacauaucugguuccgcccucuguggaauccaagaccaaaccuuuuagccuccccauucugacacuuucugagcugaccaauucccgguucccugugcccaucgauagccucuuuacggcccaaaacaauguccuucaggugcagugucagaacggacgcugcacacuugacggcgagcugcaagggaccacacagcuccugccgucuggaauuugugcuuucagaggccggguuaccgcccagaucaaucagcgcgauagauggcauaugcaacugcagaaccucaauggcaccacauacgacccuacggaugacgugcccgccccucuggggacccccgacuucaagggagucguguuuggcaugguuucccagcggaacguggggaaugaugcuccuggaagcacacgcgcgcaacaggccugggucuccaccuauucuccccaguucgugccgaaacuuggcagcgucaaccugagaauuuccgacaaugaugacuuucaguuccaaccuacaaaguuuacccccguggggguuaacgaugacgaugacggacaccccuuccggcagugggaacucccuaauuacagcggcgagcugacgcuuaacaugaaucuggcuccgcccguggccccuaacuuucccggcgaacagcuccuguucuuuagaucuuucgucccuugcuccgggggauacaaccagggcaucaucgauugucugauuccccaagaguggauccagcauuuuuaucaggaaagcgccccuucucagagcgacguggcucucauucgcuacguuaaucccgauacagggcggacccuguucgaggccaagcugcacagauccggauauaucaccguggcgcacucuggcgacuacccgcuggucgugccugcuaacgggcauuuucgcuucgacagcugggugaaucaauucuauucccucgcccccaugggcacaggaaacggccggagacgcgcccaguga

SEQ ID NO: 28263 - RNA, 1623 nt, Artificial Sequence; identical to SEQ ID NO: 27460
  derived and/or modified sequence opt5 from capsid_protein__Norovirus__ALL73882

SEQ ID NO: 28264 - RNA, 1623 nt, Artificial Sequence; identical to SEQ ID NO: 27460
  derived and/or modified sequence opt5 from capsid_protein__Norovirus__ALL73888

SEQ ID NO: 28265 - RNA, 1623 nt, Artificial Sequence
  derived and/or modified sequence opt5 from capsid_protein__Norovirus__ALQ43927
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucucacaacuacaccaugaaucucgcuucccagaacuggagcaauuaugaucccaccgaggaaauuccugcgccccugggcacaccggacuucguugggaaaauccagggagugcuuacgcagaccacaagaaccgacggcuccacacgggggcauaaggccaccgucuacacgggaucugcugauuuugccccuaagcugggccgcgugcaauucgagacagacaccgaucacgacuuugaagccaaccagaauaccaaauucacacccguuggggugauccaggauggaggcaccacacacagaaacgagccccaacaguggguccucccuagcuacuccggccggaauacgccgaacgugcaucuggcucccgccguggcgccuaccuuucccggggaacagcuucuguucuuucgcagcacaaugccuggauguucuggcuaucccaauauggaccucgauugccugcugccucaggaguggguucaauacuucuaucaggaggcugcccccgcccaguccgacgucgcucuccugagauuugugaacccggauaccgggcgggugcuuuucgaauguaagcugcacaaaagcggauacgucacaguggcccauaccggccagcacgaccucguuauuccucccaauggguauuuuagauucgauucuugggugaaccaauucuacacgcuggcuccuaugggcaacggaaccggccgccggagaccccuuuga

SEQ ID NO: 28266 - RNA, 1623 nt, Artificial Sequence
  derived and/or modified sequence opt5 from capsid_protein__Norovirus__ALQ43928
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggaaugcuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauccaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugauuccucccaauggcuauuuucgcuucgauagcuggguuaaccaauucuacacgcuggcuccuauggggaacggcaccggacggagacgcccccuuuga

SEQ ID NO: 28267 - RNA, 1623 nt, Artificial Sequence; identical to SEQ ID NO: 26819
  derived and/or modified sequence opt5 from capsid_protein__Norovirus__ALQ44123

SEQ ID NO: 28268 - RNA, 1623 nt, Artificial Sequence; identical to SEQ ID NO: 27460
  derived and/or modified sequence opt5 from capsid_protein__Norovirus__ALQ44124

SEQ ID NO: 28269 - RNA, 1623 nt, Artificial Sequence; identical to SEQ ID NO: 27460
  derived and/or modified sequence opt5 from capsid_protein__Norovirus__ALQ44125

SEQ ID NO: 28270 - RNA, 1644 nt, Artificial Sequence
  derived and/or modified sequence opt5 from capsid_protein__Norovirus__BAB83514
augaagauggccagcuccgacgcugcccccucuaccgauggcagcgcggggcuggugccugaggucaacaaugaaacaauggcucucgagccgguugugggagcuccccuggccgccccuguggccggccagcacaacaucauugaccccuggaucaaaaugaauuucguccaagcuccuaacggggaauuuacggugucccccagaaaugccccuggagagauucuucuggaucucgaacugggcccggaccuuaaccccuaccugucucaucucgcgcggauguauaauggguacgccggaggcauggagguucaggugguccuggcuggcaacgccuucaccgcugggaagaucauuuuugccgcggugccucccaauuucccugccgagaaccugagcgcugcccagguuacaaugugcccccacgugaucgucgaugugcgccagcucgaaccggugaugcugccuaugcccgacaucagaaauaaacuuuuucauuauaaccaagucgaugacccuaagcugcggcuccuggcuuaccuuuauacaccccugcgcgccaauaacgccggagaugacguuuucaccguguccuguagagugcucacccggcccacaccugauuuugaguucauguuucuggucccgcccaccguggaaucuaaaacgaagccuuucagccugcccucccucacccuggacgagcuuagcaauucucgcuuuccugcucccauuguucagcuguacacaaacccgcacgauaaccucgugguccagccucagaauggcagaugcaccaucgacgggcugcuucaaggaacaacccagcugguguccuguaacguuugcagcuuccggggcacgauuggggacggacagcccgcgucucauuccgaggaagagaucaugccuauggccuuuaauauucagcgcgaaaucaugcucgagaaccuggauggcacacccuaugacccugcugaugacauucccgccgugcugggcagcccggauuuccaaggggucaucuucggaauccucucucagagaaauaccgacggccagacacgggcccacgaagcuaagguggauacccgcgccgcgagauuugcuccuaaacugggguucgucguggccaccguugaguccacagacuuucacgccaaccaacccagccgguucacgcccgugggacuuggcggggauaauaaccaggacuuuaaucaguggcgccugccugcuuacggaggcgcccucaccaacaauacaaaccuggcuccgcccgucaugccuguguaccccggcgagcagcuucuguucuuuagaucccaacucccuucuagcgggggaguugugggcggguggcuggauugucugcucccccaggaauggguccagcauuucuuucaggaguccgccaccagccaaucugacguggcgcuggugcgguauauuaauccuacaaccggaagaguucuuuucgaagccaagcugcacaaacagggcuuucucacggucgcugccuccgggagcuacccccugguggugccggcugacggcuauuuccgcuuugagucuugggucaaccaguucuacacacuggccccuaugggaaauggcagcgggcggagacgcgcgcgguga

SEQ ID NO: 28271 - RNA, 1644 nt, Artificial Sequence
  derived and/or modified sequence opt5 from capsid_protein__Norovirus__BAB83516
augaagauggccagcuccgacgcucccccuucuaccgauggcagcgccgggcuggugccggaggucaacaaugaaacaauggcgcucgagcccguugugggagcuccucuggccgcccccguggcuggccagcacaacaucauugacccuuggaucaaaaugaauuucguccaagcccccaacggggaauuuacgguguccccuagaaaugcuccgggagagauucuucuggaucucgaacugggccccgaccuuaacccuuaccugucucaucucgcccggauguauaauggguacgcgggaggcauggagguucaggugguccuggccggcaacgcuuucaccgccgggaagaucauuuuugcugccgugcccccuaauuuccccgcggagaaccugagcgccgcucagguuacaaugugcccgcacgugaucgucgaugugcgccagcucgaaccugugaugcugcccaugccugacaucagaaauaaacuuuuucauuauaaccaagucgaugaccccaagcugcggcuccuggccuaccuuuauacaccccugcgcgcuaauaacgccggagaugacguuuucaccguguccuguagagugcucacccggccuacaccggauuuugaguucauguuucuggugcccccuaccgucgaaucuaaaacgaagcccuucagccugccuggccucacccuggacgagcuuuccaauagccgcuuucccgccccgauuguucagcuguacacaaacccucacgauaaccucaucgugcagccccagaaugggagaugcaccauugacggacugcuucaaggcacaacccagcuggucucuuguaacgugugcuccuuccgggggacgaugggagagggccagccugcugcgcauagcgaagacgagaucaugcccauggccuuuaauguucagcgcgaaauuaugcucgagaaccuggauggcucuccuuaugaccccacagaugacaucccggcugugcugggguccccugauuuccaaggagucauguucggcauucucagccagagaaauaccgacgggcagacacgggcccacgaagccaagguggauacccgcgcugccagauuugcgcccaaacugggauucgucguggcuaccguugagucuacagacuuucacgccaaccaacccucccgguucacgccugugggccuugggggagauaccaaucgcgacuuuaaccaguggcagcugccggccuacggcggcgcucucacaaauaacaccaaucuggcucccccugucaugcccguguacccuggggagcagcuucuguucuuuagaagccaacuccccuccucuggaggcguuguggccggguggcuggauugucugcucccucaggaauggguccagcauuucuuucaggagagcgccacaucccaaagcgacguggcgcuggugcgguauguuaaccccaccacgggaagaguccuuuucgaagccaagcugcacaaacagggcuuucucacaguggcugccucuggguccuacccgcugguggucccugcugacggcuauuuccgcuuugagagcugggugaaucaguucuacacccuggcccccaugggaaacggcucugggcggagacgcgcgcgguga

SEQ ID NO: 28272 - RNA, 1629 nt, Artificial Sequence
  derived and/or modified sequence opt5 from capsid_protein__Norovirus__BAD72797
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcccgccuuucgaccccagcgaagauauuccugcgccccucggggucccugacuuccagggacgcguguuuggcgucaucucucaaagagauaagcagaaugccgcugggcacuccgagcccgccaaccggggacaugacgccgugguuccgacauacacggcucaguacaccccuaaacugggccaagugcagauugggacauggcagaccgaugaccugcaggucaaucaacccgugaaguucacacccguuggacucaacgauaccgaacacuuuaaucaguggguggucccucgcuaugccggcgcgcugaaccuuaauacgaaccuggcuccgagcguggcccccguguucccuggcgagagacuccuguuuuuccgguccuacaucccccuuaaagggggauauggcaauccugccaucgacugccugcucccccaggaguggguucagcauuuuuaccaagaagcugccccuucuaugagcgaggucgcucuggugcgcuauauuaaccccgauacagggagagcccuguucgaagcgaagcuccaccgggccggauuugugaccgucuccagcaauaccucugcuccggugguugugccugccaacggcuacuucagauuugacuccugggucaaccaguucuauagccuggcucccaugggggccggcaauggacgccggagagugcaguga

SEQ ID NO: 28273 - RNA, 1647 nt, Artificial Sequence
  derived and/or modified sequence opt5 from capsid_protein__Norovirus__BAD72798
augaagauggccagcaacgacgcugcccccuccaaugauggcgcggcugggcuggugccugagaucaacaaugaagccauggcccucgacccggucgcuggagccgcuauugccgcgccccugaccggccagcaaaacaucauugauccuuggaucaugaauaacuucguucaggcccccgggggagaguuuacagugucuccuagaaauagccccggcgaagugcuucugaaccucgagcuggggccugaaauuaauccguaccuugcucaccuggcccggauguauaacggauacgcuggcggcuucgagguccaggugguucucgccgggaaugcguuuacggccggaaaaaucaucuucgcugccauucccccuaacuuucccaucgacaaucuguccgcugcccagauuaccaugugcccucaugugaucgucgaugugcgccaacuggagcccguuaaccucccgaugccugacgugagaaauaacuucuuuuauuacaaccagggcucugauagccggcugcgccuuauugccaugcuguauacaccccucagagcuaauaacuccggggacgaugucuucaccgugucuugucgggugcugacacgcccuagccccgacuuuuccuucaauuuucuuguucccccuaccgucgaaagcaagacaaaaccguucacccugcccauccucacgauuucugagauguccaacagcagauuuccugugcccaucgaaucucugcacaccuccccuacagagaauaucgugguccagugccagaacggacgggugacccuggauggcgagcucauggggacaacccaacugcuucccagccagauuugugcguuccgcggaguucugacgagaucuacaucccgggccagcgaccaggcugauaccgccacaccgcgccucuucaauuacuauuggcaugugcagcuggacaaccuuaauggcaccccuuacgaccccgccgaagauaucccuggcccccuggggaccccugacuuuagaggaaaggucuucggcguggcuucccaacggaaccccgauucuacaacgcgcgcccacgaggcgaaaguugacaccacagcugggagauuuaccccgaagcucggaagccuggaaauuuccacagagagcucugauuucgaccagaaucagccuacccgguuuacgcccgugggcaucggggucgauaacgaagccgacuuccaacaguggucccugcccgauuacagcggacaguuuacacauaauaugaaccucgccccugcuguggccccgaauuuccccggcgagcagcugcuguuuuucagaucucaacuuccuagcuccggcgggcgcucuaacggaguccucgacugccuggugccccaggaguggguucagcacuuuuaucaggaaagcgcuccugcccaaacccagguggcgcuuguccgguacgugaaccccgauaccggcagaguucuguucggggccaagcuccacaaacugggauuuaugacaauugcuaagaauggcgacuccccuaucaccgugcccccgaacggguauuuccgcuucgagagcugggucaauccuuuuuacacacuggcccccaugggcacgggaaacggccggagacgcauccaguga

SEQ ID NO: 28274 - RNA, 1647 nt, Artificial Sequence
  derived and/or modified sequence opt5 from capsid_protein__Norovirus__BAD72799
augaagauggccagcaacgacgcugcccccuccaaugauggcgcggcugggcuggugccugagucuaacaaugaagucauggcccucgagccgguugccggagcuagccuggccgcucccgugaccggccagacaaacaucauugacccuuggaucagaaugaauuucgugcaagcccccaacggggaauuuacggucuccccucgcaauucucccggagaggugcuucugaaccucgaacugggcccugagcuuaauccguaccuggcgcaccucagccggauguauaacggguacgccggaggcauggagguucagauuaugcuggcuggcaaugccuucaccgcugggaaacugaucuuugccgcggugcccccucauuuccccauugaaaaccucuccccuccccagaucacaauguuuccgcacgucaucauugaugugagaacccuggagccuguucuucugcccaugccugacauccgcaauucuuucuuucauuucauucagcgggaugaacccaagaugagacucguggccaugcuguauacaccccuucggagcaacggauccggcgacgaugucuuuaccgugagcugccgcgugcugacaagaccuaccccggacuucgauuuuacguaccucguucccccuaccgucgagucuaaauccaagcccuucacacugccuauccugacccucggggagcugacaaauagccgguuuccccuuccgauugacgugcuguauaccaacccuaacgaaucugcuaucgugcaaugucagaauggacgcugcacgcucggcggggagcugcagggaacagcccagcuucugcccaccggcauuugugcuuucagaggcaaagucacacaacaggugcaggaugaacaccgggggacccauuggaacaugaccguuacaaagcucaauggaacgccuuucgaccccaccgaggaugugccugcuccccugggcacaccggacuuuuccgggcagaucuacggagucaucagccaacgcaacaccaauacagugccuggcgaagggaaccugcccgccaauagagcccacgaggcgguuauugccaccuauucucccaaguucacgccuaaacucggaaacauccaguuuuccacaugggagacccaggacgugagcuccggccaaccgaccaaguucacacccgucggccuggcuucuguggaugccaauagccacuuugaccaguggacccuuccuuccuacagcggggcccugacacucaacaugaaucuggcucccucugucgccccuguguuccccggagaaugccuucuguuuuuccgguccuuuauuccucucaaaggcggguacggaaaccccgcgaucgauugucugaugccgcaggaguggguucagcaucuguaucaagaaagcgcuccuucucucagcgacguggcccugguccgcuacgugaaucccgagacgggcagaacccuuuucgaagccaagcugcaccggaacggguuucucacaguugcuagaaauuccgccggcccuguggucgcucccaccaacggauauuuccgcuuugauucuugggugaaccaguucuacacacuggccccgaugggcaaugggagcggacggagacgcauucaguga

SEQ ID NO: 28275 - RNA, 1623 nt, Artificial Sequence
  derived and/or modified sequence opt5 from capsid_protein__Norovirus__BAD72800
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagagauucugcucaaucuggaacuuggcccugagcugaacccguaccucgcgcaccuggcccgcauguauaauggguacgcuggaggcguggagguucaggugcugcucgccggcaacgcuuucaccgccgggaaacuggucuuugcggccauucccccucauuuccccguggauaaucuuucuccuggacagaucacaauguuuccccacguuaucaucgacgugagaacccuggaaccgguccuccugccucuucccgaugugcggaacaauuucuuucauuauaaccagcaaagcgaccagcgcaugagacugauugcuaugcucuacacaccucugcgguccaacggcucuggggaugacguguucaccgucagcugccgcguucugacaagacccucccccgauuuucacuuccauuaucucgugccuccgaccguggagagcaagacgaaacccuuuucugucccugugcugacccuuaaugaacugacaaacucccgguuccccguuccuaucgacgccauguacaccagccccaaugauucuauugugguccagccgcagaacggacgcgcuacaaucgacggcgagcuccuggggaccacgcaacuuauuccuuccggaaucuguagcuuuagaggcaagauuacaacccaccuggccgaugaccggcaccucuggaauauccaggugucuaaccugaauggcacacccuucgacccuaccgaugacguucccgccccucuggggaugcccgauuucuccggacagaucuuuggcguggucagcgagcgcgacaccgggacaaacccggcuaauagagcgcaugaugccgugcucgcuacguauuccgccaaauacaccccuaagcugggaucuguccagauuggcacaugggacaccgaagaucuucuggagcggcaacccgugaaguucacacccguugggcucaacgaaaucggacaggacaaacacuuugaucagugggugcugccuaauuacagcggcgcccuuggccugaacaugcaucucgcuccggccgucagcccccuguucccuggggagcgccugcucuuuuucagauccuauauuccccugaagggaggccacggggacccuuuuaucgauugccuugugccccaagaauggauucagcacuucuaccaggagucugcgccugcucaguccagcguugcccugcuccgguaugugaaucccgacaccggaagaacgcuguuugaggccaaacugcauaaggaaggcuucaucacagucucuagcaccgagaaccgcccggugaucgugccucccaauggguacuuucgguucgacuccuggguuaaccaauuuuauucucuugcuccuaugggcaccggaaacggcagacgccggauucaguga

SEQ ID NO: 28276 - RNA, 1620 nt, Artificial Sequence
  derived and/or modified sequence opt5 from capsid_protein__Norovirus__BAD88558
augaagauggccagcaacgacgugaaucccuccgauggcucugcugccaaccuggucccugagguuaauaacgaagugauggcgcucgagccgguggucggggcugccaucgccgcucccguggccggacagcaaaauauuaucgacccuuggauuagaaacaauuucguucaggcucccggcggggaauuuaccgugagcccucggaacgcccccggagagauccugugguccgcgccucuuggcccggaucugaaucccuaccucucucaccugagccgcauguauaacggguacgccggaggcuucgaaguccaggugauucuugcuggcaaugccuuuacagcugggaaaguuaucuucgccgcggugccucccaacuuuccuacggagggacugucccccucucaggucaccauguucccgcauaucauuguggacgugagacaacucgagccuguccugaucccccugccugauguucggaauaacuuuuaucacuacaaucaggcccaugacagcacacucaagcugauugcuaugcuuuauacaccccugcgcgccaacaacgcuggcgaugacguguucaccguguccugcagaguccucacccggcccagcccugauuuugacuucaucuuucuggugccgcccacaguugaaucucgcaccaaauccuucacggugccuguccuuaccguggaggaaaugacaaauagcagauuucccauuccucuggagaagcucuacaccgggcccucuuccgccuucguugugcagccgcagaacggacgguguacaaccgauggcguccugcuggggacgacacaacucagcgccgugaauaucugcaccuuccgcggagacgucacacacauugcuggcucuagaaacuauaccaugaaucuggcgucccagaacuggaauaacuacgauccuaccgaggaaauccccgccccucuuggcauccccgacuuuguggggaaaauucagggacugcucacacagacgacccgggcugacggcagcacacgcgcccauaaggccaccguuuccacagggucugugcacuucaccccuaagcugggaagcguccaauuuuccacggauacagacaaugauuuccagcccggccagaacaccaaauuuaccccgguggggguuauccaagacggagauagacaccagaaugagccucagcagugggugcuucccgacuacagcggccggacaggccauaacguccaccuggcucccgccguggcgccuaccuucccgggggaacaacuccuguuuuuccgcucuacaaugcccggauguuccggcuauccuaauaugaaccuggauugccuccugccccaggagugggugcuucauuuuuaccaggaaagcgcuccugcccagucugacguugcccugcucagauucgucaaucccgauacgaaccgggugcuguuugaguguaaacuucacaagagcggguauauuaccguggcucacacaggacaacaugaccugauccucccucccaacggcuacuucagauuugauuccugggucaaucaguucuauacccuggccccgauggggaacggcgcuggacgccggagagccccuuga

SEQ ID NO: 28277 - RNA, 1623 nt, Artificial Sequence
  derived and/or modified sequence opt5 from capsid_protein__Norovirus__BAD98240
augaagauggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaaaaucauuuuugccgcggugcccccuuauuuccccgucgaaaaccugagcccuucccagaucacaauguuuccccauguuaucauugaugugagaacccuggagccgguccuccugccuaugcccgacgugcggucuacacuuuuccacuuuaaucagaaggaugaaccuaaaaugcgccugguggccaugcucuacacgccccugagaagcaacggauccggcgacgaugucuucaccguuagcugccggauccuuacccgccccucuccugaguuugacuucacauaucuggugccgcccaccguggaguccaagacaaaaccuuuuacccuccccguccugacgcugggggaacucagcaauucuagauucccucuguccauugaugagauggugacaagccccaacgaaucuaucguugugcaaccgcagaacggacgggucacccuugacggcgagcugcucgggacaacccagcugcaggcuuguaauauuugcuccauccgcggaaaggugaccggccaaguuccuaacgaacagcauauguggaaucuugagauuacaaaccugaauggcacgcaguuugaucccaccgacgaugugccugcuccccucggggucccugacuucgccggagagguguucggcguccugagccagagaaaccgcggggaauccaaucccgccaaccgggcccacgacgcugugguugcgacauacucugauaaguauaccccgaaacugggacucgugcaaaucggcacauggaauaccaacgacgucgagaaucagccuacgaaguuuacacccaucgggcugaacgaaguggccaauggacauagauucgagcaguggacccuuccccgguacagcggcgcucugacccucaacaugaaucuggccccugccguugcuccgcuuuuucccggcgaacgccuccuguucuuuagauccuacgugccucugaaagggggauucggcaaccccgccauugauugucuggucccucaagagugggugcagcacuuuuaucaggagagcgcgcccucucucggggacguggcucugguucgguacgucaacccugauacaggaagagugcuuuucgaagccaagcugcacaaaggcggguuucucaccguguccagcacaucuacgggccccgucgugguuccggccaauggauauuuccgcuuugacagcugggugaaccaguucuacucccuggcuccuaugggcaccgggaauggacggagacgcuuucaauga

SEQ ID NO: 28278 - RNA, 1632 nt, Artificial Sequence
  derived and/or modified sequence opt5 from capsid_protein__Norovirus__BAE43833
augaugauggccagcaaggacgcucccaccaacauggauggcacauccggggccggacagcuggugccugaggcgucuacggcugaaccgaucagcauggagcccgucgccggcgccgcuaccgccgcugccacagcggggcaaguuaauaugauugacccuuggaucauguccaacuacgugcaggcuccccagggagaguucaccauuucuccuaauaacacacccggcgauauccucuuugaccugcagcuugggccucaccugaauccguuccucagccaucuggcccaaauguauaacggaugggugggcaauaugaaagucagagugcuucuggccggcaacgcuuuuaccgccgggaagauuaucaucuccugcguucccccuggauucgcggcccagaaugugucuauugcucaggccacaauguuuccccacgucaucgcugaugugcggguucucgaaccuauugaagugccccuggaggacguccgcaacgugcuguuccauaauaacgauagcaccccgacgaugagacucaucuguaugcuguacaccccucuucgggccuccggcucuagcuccgggacagaccccuuugugauugccggacgcguccugaccugcccuagccccgauuucaauuuucucuuccugguucccccuaacguggagcagaaaacaaagccguuuucugugcccaaucuuccucugaacguccucuccaacagcagagugcccucucugaucaaauccaugaugguuagccaagaccacggccagauggugcauuuccagauugggcgggucacccuggauggacagcuccaaggcacgacaccuaccuccgcuucucagcuguguaagauccgcggcacaguguaucacgcgaccgggggacagggccuuaaucugaccgaaaucgacgggacacccuaccacgccuuugagagcccggcuccuauuggauuccccgaucucggcgaaugcgacuggcauaucaacgccuccccugccaaugcuuucacggacgggagcauuauccacagaauugauguugcccaagacucuaccuuugcgccccaucugggaacaauccacuauaccaacgcuaauuacgaugccaacgugucccuuaucuguagccuggaguggcucucuccucccagcggcggcgccccgaaggucaauccuugggcuauuccccgguauggguccacacugaccgaggccgcucagcuggcgcccccuaucuacccgcccggauucggcgaagccauuguguuuuucaugucugacuuuccuaucgccaacgggagcgauggacucuccguccccugcacgauuccucaggaguucgugacacacuuuguuaaugaacaggcucccacccgcggcgaggccgcucugcuucauuacguggacccugauacccacagaaaccugggggaguucaaacucuaucccgaaggcuuuaugacaugugucccgaauagcucuggauccggcccucaaacccugcccaucaacgggguguucacauuuaucagcuggguuucucgguucuaccagcuuaagccugugggaacgaccggccccguccgcagacuggggauucggcgcuccuga

SEQ ID NO: 28279 - RNA, 1647 nt, Artificial Sequence
  derived and/or modified sequence opt5 from capsid_protein__Norovirus__BAE48588
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgcgcaaaaucaucuucgccgcuauucccccuaacuuucccaucgacaaucuguccgccgcucauauuacaaugugcccucacgugaucgucgaugugagacagcuggagcccguuaaccucccgaugccugacgugcggaauaacuucuuucauuauaaccaaggaucugauagccgccugagacuuauugccaugcuguacacaccccuccgggccaauaacuccggcgacgaugucuucaccgugucuugucgcgugcugaccagaccuagccccgacuuuuccuucaauuuucuugugcccccuacacuggaaagcaagaccaaaccguucacgcuccccauccugaccauuucugagauguccaacagccgguuuccuguucccaucgauucucugcacacauccccuaccgaaaauaucguggugcagugccagaacgggcgcgucacacucgacggagagcugaugggcaccacgcagcuucugcccagccaaauuugugcuuucagaggggugcucacacggucuaccucccgcgcgagagaucaggccgacacagcuaccccgcggcuguucaauuauuacuggcauauccagcuugacaaccugaauggaaccccuuaugaucccgccgaggacauuccuggcccccucggcacaccugauuuucgcgggaagguuuucggaguggccagccagagaaaccccgacuccacgacccgggcucacgaagccaaagucgauacaaccgcgggcagauuuacaccgaagcuggggucucuggagaucagcaccgaauccgacgauuucgaccaaaaucagccuacgcgcuuuacacccgugggaauuggcguugauaacgaggcugacuuccagcaauggagccuccccgauuacucugggcaguuuacccacaauaugaaccuggccccugccguggcuccgaauuuccccggagaacagcuucuguuuuuccggucccagcucccuagcucuggcggcagaagcaacgggauccuggacugccuugucccccaagagugggugcagcauuuuuaccaggaguccgccccuucucagacccaagucgcucuggugcgcuauguuaaccccgacacaggacggguccucuucgaagccaagcugcacaaacugggcuuuaccacaaucgcgaagaauggggauagcccuauuacggugcccccgaacggauacuucagauucgaguccugggucaauccuuuuuauacccucgcccccaugggcacagggaacggccgccggagaaaucaguga

SEQ ID NO: 28280 - RNA, 1647 nt, Artificial Sequence
  derived and/or modified sequence opt5 from capsid_protein__Norovirus__BAE48589
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuuauuuucccaucgacaaccuguccgccgcucagauuacaaugugcccucaugugaucgucgaugugcgccaacuggagcccguuaaucucccgaugccugacgugagaaacaauuucuuucacuacaaccagggcucugauagccggcugcgccuugucgccaugcuguauacaccccucagagccaacaauuccggggacgauguguucaccgugucucugcggguccuuacccgcccuagccccgacuuuuccuucaacuuucugguucccccuacaguggaaagcaagaccaaaccguucacgcuccccauucugaccaucucugagauguccaauagcagauuuccugugcccauugauucucugcauacauccccuaccgaaaacaucgucgugcagugucagaauggacggguuacacucgacggcgagcugauggggaccacgcaacuucugcccagccagaucugcgcuuuccgcggagugcucacaagaucuaccucccgggcgagcgaucaggccgacacagcuaccccgcgccuguucaacuacuauuggcacauucagcuugacaaucugaacggcaccccuuacgaucccgccgaggacaucccuggcccccucgggacaccugauuuuagaggaaaggucuucggcguggccucccaacggaaucccgacucuacgacccgcgcucaugaagccaaaguugauacaaccgcggggagauuuacaccgaagcugggaagccuggagauuuccaccgaaagcgacgauuucgaccagaaccagccuacgcgguuuacacccgugggcaucggggucgaucacgaggcugacuuccaacaguggucucuccccgauuacuccggacaguuuacccacaauaugaaccuggccccugccguggcuccgaauuuccccggcgaacagcuucuguuuuucagaagccaacucccuucuagcggcgggcgcuccaacggcauucuggacugucuugucccccaggagugggugcagcauuuuuaucaggagucugccccugcucaaacccagguugcccuggugcgguacgucaaucccgacacaggaagaguucucuucgaagcgaagcugcacaaacugggguuuaugaccaucgccaagaacggagauagcccuaucacagugcccccgaacggcuauuuccgcuucgaguccugggugaauccuuuuuacacgcucgcucccauggggaccggcaacggacggagacgcauucaguga

SEQ ID NO: 28281 - RNA, 1647 nt, Artificial Sequence
  derived and/or modified sequence opt5 from capsid_protein__Norovirus__BAE48590
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucuggaccucgagcuggggccugaaauuaacccguaccuugcccaccuggcucggauguauaauggauacgccggcggcuucgagguccaggugguucucgcugggaacgccuuuaccgcgggaaaaaucaucuucgccgcuauucccccuaauuuucccaucgauaaccuguccgccgcucagauuacaaugugcccucaugugaucgucgacgugcgccaacuggagcccguuaaucucccgaugccugaugugagaaacaccuucuuucacuauaaucagggcucugacagccggcugcgccuuauugccaugcuguacacaccccucagagccaacaacuccggggaugacgucuucaccgugucuugucgggugcugacacgcccuagccccgauuuuuccuucaauuuucuuguucccccuaccgucgaaagcaagacgaaaccguucacccugcccauccucacaauuucugagauguccaacagcagauuuccugugcccaucgacucucugcauaccuccccuacagaaagcaucgugguccagugccagaauggacgggugacccuggauggcgagcucauggggacgacacaacugcuucccucucagauuugugcuuuccgcggaguucugaccagauccacaagccgggcguccgaccaggccgacaccgcuaccccgcgccucuucaacuauuacuggcacauccagcuggauaaucuuaacggcacaccuuaugaccccgccgaggauauuccuggcccccuggggacgccugacuuuagaggaaagguguucggcgucgccucucaacggaaucccgauagcaccacacgcgcucaugaagccaaaguggacaccacaaccgggagauuuacgccgaagcucggaucccuggagaucagcacagaaucugaugacuucgaucagaaccagccuacccgguuuacccccguuggcauugggguggaccacgaggcggauuuccaacaguggucccugcccgacuacagcggacaguuuacacacaauaugaaccucgcuccugccgucgccccgaauuucagaggcgaacagcugcuguuuuuccgcucucaacuucccagcuccggcgggcggucuaacggaacccucgacugccuggugccucaggaguggguccagcauuuuuaccaggagagcgcucccgcccaaacacagguggcucuuguuagauaugugaauccugauacgggccgcguccuguucgaagccaagcuccacaaacugggguuuaugaccaucgcgaagaacggagacucccccaucacagugccucccaauggcuacuuccgguucgagagcuggguuaacccguuuuauacccuggccccuauggggacaggcaacggaagacgccggauucaguga

SEQ ID NO: 28282 - RNA, 1644 nt, Artificial Sequence
  derived and/or modified sequence opt5 from capsid_protein__Norovirus__BAE92970
augaagauggccagcaacgacgcuucccccucuaccgauggcagcgccgggcuggugccugaggucaauaacgaaacaauggcgcucgagccgguugugggagcuccccuggccgccccuguggcuggccagcacaauaucauugaccccuggaucaaaaugaacuucguccaagccccuaauggggaauuuacggugucccccagaaacgcuccuggagagauucuucuggaucucgaacugggcccggaccuuaaucccuaccugucucaucucgcccggauguauaacggguacgcgggaggcauggagguucaggugguccuggccggcaaugcuuucaccgccgggaagaucauuuuugcugccgugccucccaacuucccugcggagaaucugagcgccgcucagguuacaaugugcccccacgugaucgucgaugugcgccagcucgaaccggugaugcugccuaugcccgacaucagaaacaaacuuuuucauuauaaucaagucgaugacccuaagcugcggcuccuggccuaccuuuauacaccccugcgcgcuaacaaugccggagaugacguuuucaccguguccuguagagugcucacccggcccacaccugauuuugaguucauguuucuggucccgcccaccguggaaucuaaaacgaagccuuucagccugcccucccucacccuggacgagcuuagcaacucucgcuuuccugcccccauuguucagcuguacacaaacccgcacgauaaucucgugguccagccucagaacggcagaugcaccaucgacgggcugcuucaaggaacaacccagcugguguccuguaauguuugcagcuuccggggcacgcucggggacggacagcccgcuucucauuccgaggaagagauuaugccuauggcguuuaacgugcagcgcgaaaucaugcuggagaaucuggauggcagccccuaugacccuacagaugacauucccgccguccucggcucuccggauuuccaagggguggucuucggaauccugucccagagaaacaccgacggccagacacgggcucacgaagccaagguggauacccgcgccgcuagauuugccccuaaacuuggguucguuguggcgaccgucgagagcacagacuuucacgcuaaucaacccucccgguucacgcccgugggacugggcggggauggaaaccaggacuuuaaucaguggucucucccugccuacggcggcgcccugaccaacaauacaaaccuugcuccgcccgccaugccuguuuaccccggggagcagcuccuguucuuucgcagccaacugccuuccagcggaggcguggucgggggauggcuggauugucuccugccccaggaaugggugcagcauuucuuucaggagucugcuaccucccaaagcgacguggcccuuguuagauauauuaauccuacaaccggccggguccuguucgaagcgaagcuccacaaacagggguuucugacgguggccgcuucuggcagcuacccccugguggucccggccgacggauauuucagauuugaguccugggugaaccaguucuacacacuugcuccuaugggcaaugggucuggacgccggagcgccagauga

SEQ ID NO: 28283 - RNA, 1623 nt, Artificial Sequence
  derived and/or modified sequence opt5 from capsid_protein__Norovirus__BAE98191
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaacaaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcaccaaaccuuucacaguucccauccugaccguggaggaaaugacaaacagcagauuuccuauuccccuugagaagcuguucaccgggccgucuuccgccuucgucgugcagccucagaauggacgguguacgacagauggcguucuccuggggaccacacaacugagccccgugaacaucugcaccuuucgcggagacgucauccauauuccuggcaccagaacauaccggaugaaucucgccucucagaacuggaauaacuaugaucccacggaggaaaucccugcuccccugggcaccccggacuucguggggaaaauucagggaaugcuuacacagaccacaaagggcgacggguccacccgcggacacaaggcgacggucagcacaggcuccguggauuuuaccccuaaacuggggucuguucaauucgccaccgacacagauaaugacuuugagaccggacagaacacaagauucacgcccgugggcgucauccaggauggcagcuccgcucaucggaaugaaccccaacagugggugcucccugacuacagcgggcgcaccguucacaacgugcaccuggccccggccgucgcucccacauuuccuggagagcagcuucuguucuuuagaucuaccaugcccggcuguuccggguacccuaauauggaucucgacugccugcugccccaggaaugggugcaacauuucuaucaggaggccgcgccuagccagucugauguggcucuccugcgguuuguuaaccccgacacaggaagaguccuuuucgaguguaagcugcacaaagccggcuacgugaccguggcccauacggggcagcacgaucucgucauuccgccuaauggcuauuuucgcuucgacagcugggugaaccaauucuacacccuggcucccaugggaaauggcgccgggcggagacgcgcucuuuga

SEQ ID NO: 28284 - RNA, 1623 nt, Artificial Sequence
  derived and/or modified sequence opt5 from capsid_protein__Norovirus__BAE98194
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgccaccgacacagauaacgacuuugagaccggacagaauacaagauucacgcccgugggcgucauucaggauggcagcuccgcucaucggaacgaaccccaacagugggugcucccugacuacagcgggcgcaccguucacaaugugcaccuggccccggccgucgcucccacauuuccuggagagcagcuucuguucuuuagaucuaccaugcccggcuguuccggguacccuaacauggaucucgacugccugcugccccaggaaugggugcaacauuucuaucaggaggccgcgccuagccagucugauguggcucuccugcgguuuguuaaucccgacacaggaagaguccuuuucgaguguaagcugcacaaagccggcuacgugaccguggcccauacggggcagcacgaucucgucaucccgccuaacggcuauuuucgcuucgacagcugggugaaucaauucuacacccuggcucccaugggaaacggcgccgggcggagacgcgcucuuuga

SEQ ID NO: 28285 - RNA, 1623 nt, Artificial Sequence
  derived and/or modified sequence opt5 from capsid_protein__Norovirus__BAE98197
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccagaacauaccggaugaaccucgccucccagaauuggaacaauuaugauccuacggaggaaauucccgcuccucugggcacccccgacuucguggggaaaauccagggaaugcuuacacagaccacaaagggcgacgggagcacccgcggacacaaggcgacggucuccacaggcucuguggauuuuaccccgaaacuggggagcguucaauucgccaccgacacagauaacgacuuugagaccggacagaauacaagauucacgccugugggcgucauucaggauggcuccagcacccaucggaacgaaccccaacagugggugcuccccgacuacucugggcgcacaguucacaaugugcaccuggcuccugccgucgccccgaccuuucccggagagcagcuucuguucuuuagauccacaaugccuggcuguagcggguaccccaacauggaucucgacugccugcugccucaggaaugggugcaacauuucuaucaggaggcugcccccucucagagcgauguggcgcuccugcgguuuguuaauccugacaccggaagaguccuuuucgaguguaagcugcacaaagcuggcuacgugacgguggcccauaccgggcagcacgaucucgucauucccccgaacggcuauuuucgcuucgacuccugggugaaucaauucuacacacuggccccuaugggaaacggcgcugggcggagacgcgcccuuuga

SEQ ID NO: 28286 - RNA, 1623 nt, Artificial Sequence
  derived and/or modified sequence opt5 from capsid_protein__Norovirus__BAF45861
augaagauggccagcaacgacgcuaaucccuccgauggcucugccgcgaaccuggugccugaggucaauaacgaaguuauggcucucgagccgguggugggggccgccaucgcugcccccgucgcuggacagaccaaugugauugacccuuggaucagaaacaauuucguucaagcccccggcggggaauuuacagugagcccucggaacgcgcccggagagauucugugguccgccccucuuggcccggaucugaaucccuaccucucucaccuggcucgcauguauaacgggcaugccggaggcuucgaaguccaggugauccuugcuggcaaugccuuuacggcggggaaaauuaucuucgccgcuguuccucccaacuuuccuaccgagggacugagccccucccaggugacaauguucccgcacaucauugucgacgugagacagcucgagccugugcugaucccccugccugauguccggaauaacuuuuaccauuauaaucaaucuaacgacagcaccauuaagcucaucgccaugcuguacacaccccuucgcgcuaacaaugccggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcggagccuucgucgugcagccucagaauggccgguguaccacggacgggguucuccugggaacaacccagcugucucccgugaacaucugcacauuucgcggcgaugucacccacaucgcuggcuccagaaauuauaccaugaaccucgcgagccugaauuggaacaauuacgacccuacagaagagauucccgccccucuugggacgcccgauuucgugggaaaaauccaaggcguccugacccagacaaccaagggggacggaucuacacggggccauaaggcuaccguguauacgggguccgccccguuuacaccuaaacucggaagcguucaguucuccaccgacaccgaaaacgauuuugagacacaccagaauaccaaguucacacccgugggcgucauucaagacggcucuacgacccaccgcaacgaaccccagcagugggugcugccuagcuacuccgggagaaauguucauaacgugcaccuugccccggcugucgcccccacauuuccuggagagcaacuccuguucuuucggagcaccaugcccggcuguucuggguacccuaauauggaucuggacugccugcucccccaggagugggugcagcauuucuaucaggaagcggcuccugcccaauccgauguggcccugcuucgcuuuguuaaccccgacacaggaagaguccuguucgaguguaaacuccacaagagcggcuacgugaccguggcucacacggggcagcaugaucuggucaucccgccuaacggcuauuuucgguucgacucuugggugaaucaguucuacacccuugcccccaugggaaacggcacagggagacgccgggcucuguga

SEQ ID NO: 28287 - RNA, 1620 nt, Artificial Sequence
  derived and/or modified sequence opt5 from capsid_protein__Norovirus__BAF74508
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugaucgacccuuggaucagaagcaauuucguucaggcucccggcggggaauuuacgguguccccucggaacgcccccggagagauucuguggucugcgccucuuggcccggaucugaaucccuaccucagccaccuggcccgcauguauaacggguacgcuggaggcuucgaaguccaggugauccuugccggcaaugcuuuuaccgccgggaaaauuaucuucgcggccguuccucccaacuuuccuacagagggacugucccccucucaggugaccauguucccgcauaucauugucgacgugagacaacucgagccugugcugaucccccugccugauguccggaauaacuuuuaucacuacaaucagagcaacgacuccacaauuaagcucaucgcuaugcuguauacaccccuucgcgccaauaacgcuggcgaugacguuuucaccgugagcugcagagugcugacccggcccucuccugauuuugacuucauuuuucucgucccgcccacgguggaaucccgcaccaaaccuuucacaguucccauccugaccguggaggaaaugagcaacucuagauuuccuauuccccuugagaagcuguacacagggccguccagcgccuucgucgugcagccucagaauggacgguguaccacggauggcguucuccuggggacaacccaacugucugccgugaacaucugcacauuccgcggagacgucacccauaucgcuggcucccacgauuauaccaugaaucucgcgagccagaacuggaauaacuacgaccccacagaggaaauuccugcuccccugggcacgccugacuuuguggggaaaauccagggaguccuuacccagacaaccagaggcgauggguccacacgggcccauaaggccaccgugucuacgggaagcguucacuucacacccaagcugggcuccgugcaauacaccaccgacacaaauaacgauuuucagaccgggcagaauacaaaauucacgccggucggagugauucaagacggcgauaaccaccagaaugagccucagcaguggguucuccccaacuauagcggccgcaccgggcauaaugugcaccuggcccccgcugucgccccuacauuuccgggagaacaacuucuguucuuuagaucuaccaugcccggcuguuccggguacccuaacaugaaucucgacugccugcugccccaggagugggugcagcauuucuaucaggaagcggcuccugcccaaagcgauguggcccuccugcgguuuguuaaccccgacacaggacgcguccuuuucgaguguaagcugcacaaaucuggcuacgugaccguggcucacacggggccucaugaucucgucauucccccgaacggcuauuuuagauucgacagcugggugaaucaguuuuacacccuggccccuaugggaaacggcgcugggcggagacgcgcccuuuga

SEQ ID NO: 28288 - RNA, 1620 nt, Artificial Sequence
  derived and/or modified sequence opt5 from capsid_protein__Norovirus__BAF74509
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguacaccgggccgucuuccgccuucgucgugcagccucagaauggacgguguacaaccgauggcguucuccuggggacgacacaacugagcgccgugaacaucugcaccuuccgcggagacgucacacauaucgcuggcucucacgauuauaccaugaaucucgcgucccagaacuggaauaacuacgaccccaccgaggaaauuccugcuccccugggcacaccugacuuuguggggaaaauccagggaaugcuuacgcagaccacaagagaggauggcagcacccgggcccauaaggccacagucuccaccgggucugugcacuucacgcccaagcugggaagcguucaauacacaaccgacaccaauaacgauuuucagacaggccagaauaccaaauucacaccggugggggucauucaagacggaaacaaucaccagaacgaaccucagcagugggugcuccccaauuauuccggccgcacgggccauaacguucaccuggcccccgcuguggccccuaccuuuccgggggagcaacuucuguucuuuagaagcacaaugcccggauguucuggcuacccuaacaugaaucucgauugccugcugccccaggaauggguccagcauuucuaucaggaggcggcuccugcccaauccgacguggcccuccugcgguuugugaaccccgauaccgggcgcguucuuuucgaguguaagcugcacaaaagcggauacgucacaguggcucacaccggcccucaugaccucgugauucccccgaauggguauuuuagauucgauucuugggucaaccaguuuuacacgcuggccccuaugggcaauggagcuggccggagacgcgcccuuuga

SEQ ID NO: 28289 - RNA, 1620 nt, Artificial Sequence
  derived and/or modified sequence opt5 from capsid_protein__Norovirus__BAF74510
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguuuugcagagugcugacacggcccuccccugauuucgacuuuauuuuccucgucccgcccaccguggaaagccgcacgaaaccuuuuaccguucccauccugacaguggaggaaaugucuaacuccagauucccuauuccccuugagaagcuguacaccgggccgagcucugccuucgucgugcagccucagaauggacgguguacaaccgauggcguucuccuggggacgacacaacuguccgccgugaacaucugcaccuuucgcggagacgucacacauaucgcuggcagccacgauuauaccaugaaucucgcgucucagaacuggaauaacuacgaccccaccgaggaaauuccugcuccccugggcacaccugacuucguggggaaaauccagggaaugcuuacgcagaccacaagagaggauggcuccacccgggcccauaaggccacagucagcaccggguccgugcacuuuacgcccaagcugggaucuguucaauacacaaccgacaccaauaacgauuuccagacaggccagaauaccaaauuuacaccggugggggucauucaagacggaaacaaucaccagaacgaaccucagcagugggugcuccccaauuauagcggccgcacgggccauaacguucaccuggcccccgcuguggccccuaccuucccgggggagcaacuucuguuuuucagauccacaaugcccggauguagcggcuacccuaacaugaaucucgauugccugcugccccaggaauggguccagcauuuuuaucaggaggcggcuccugcccaaucugacguggcccuccugcgguucgugaaccccgauaccgggcgcguucuuuuugaguguaagcugcacaaauccggauacgucacaguggcucacaccggcccucaugaccucgugauucccccgaauggguauuucagauuugauagcugggucaaccaguucuacacgcuggccccuaugggcaauggagcuggccggagacgcgcccuuuga

SEQ ID NO: 28290 - RNA, 1620 nt, Artificial Sequence
  derived and/or modified sequence opt5 from capsid_protein__Norovirus__BAF74511
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccuauuccccuugagaagcuguucaccgggccgucuuccgccuucgucgugcagccucagaauggacgguguacaaccgauggcguucuccuggggacgacacaacugagcgccgugaacaucugcaccuuucgcggagacgucacacauaucgcuggcucucacgauuacaccaugaaucucgcgucccagaacuggaauaacuaugaccccaccgaggaaauuccugcuccccugggcacaccugacuucguggggaaaauccagggaaugcuuacgcagaccacaagagaggauggcagcacccgggcccauaaggccacagucuccaccgggucugugcacuuuacgcccaagcugggaagcguucaauacacaaccgacaccaauaacgauuuccagacaggccagaauaccaaauuuacaccggugggggucauucaagacggaaacaaucaccagaacgaaccucagcagugggugcuccccaauuacuccggccgcacgggccauaacguucaccuggcccccgcuguggccccuaccuucccgggggagcaacuucuguuuuucagaagcacaaugcccggauguucuggcuauccuaacauggaucucgacugccugcugccccaggaauggguccagcauuuuuaccaggaggcggcuccugcccaauccgauguggcccuccugcgguucgugaaucccgacaccgggcgcguucuuuuugaguguaagcugcacaaaagcggauaugucacaguggcucacaccggcccucaugaucucgugauucccccgaacggguacuucagauuugacucuuggaucaaucaguucuauacgcuggccccuaugggcaacggagcuggccggagacgcgcccuuuga

SEQ ID NO: 28291 - RNA, 1620 nt, Artificial Sequence
  derived and/or modified sequence opt5 from capsid_protein__Norovirus__BAF74512
augaagauggccagcaacgacgcuacccccuccgauggcucuacagccaaucuggugccugaggucaacaaugaaguuauggcgcucgagccgguggugggggcugccaucgccgcuagagucgccggacagcaaaacgugauugaccccuggauccggaauaacuucguucaggcuccuggcggggaauuuacggugagcccccgcaaugccccuggagagauucugugguccgcgccccuuggcccugaucugaacccguaccucucucaccuggccagaauguauaauggguacgcuggaggcuucgaaguccaggugauccuugccggcaacgcuuuuaccgccgggaaaauuaucuucgcggccguucccccuaauuuucccacagagggacugagcccuucccaggugaccauguucccccauaucauugucgacgugcggcaacucgagccggugcugaucccucugcccgauguccgcaacaauuuuuaucacuacaaccagucuaaugacagcacaauuaagcucaucgcuaugcuguauaccccucuuagagccaacaacgcuggcgaugacguuuucacaguguccugccgggugcugacccgccccagccccgauuuugacuucauuuuucucgucccuccgacgguggaaucuagaaccaaacccuucacaguuccuauccugaccguggaggaaauguccaauagccgguuucccgucccucuugagaagcuguacacagggcccucuuccgccuucgugguucagccgcagaacggacgcuguaccacggauggcgugcuccuggggacaacccaacugagcgccgucaauauuugcacauucagaggagacgugacccauaucgcuggcucucacgauuauaccaugaaccucgcgucccagaauuggaacaauuacgacccuacagaggaaauccccgccccucugggcacgcccgacuuugucgggaaaauucagggagugcuuacccagacaacccgggaggauggcagcacacgcgcucauaaggccaccguuuccacggggucugugcacuucacaccuaagcugggaagcguccaauacaccaccgacacaaacaaugauuuucagaccggccagaacacaaaauucacgcccguggggguuauccaagacggauccaaucaccagaacgaaccgcagcagugggugcucccuaauuauagcggcagaaccggccauaacguccaccuggcccccgcuguggcccccacauuuccuggggagcaacuucuguucuuucggucuaccaugccgggauguuccggcuaccccaauaugaaccucgauugccugcugccucaggaaugggugcagcauuucuaucaggaggcggcucccgcccaaagcgacguugcccuccugcgcuuugucaacccugauacagggagagugcuuuucgaguguaagcugcacaaaucuggauacgugaccgucgcucacacgggcccccaugaccucgugauuccucccaauggguauuuucgguucgauagcuggguuaaccaguuuuacacccuggccccgaugggcaauggagcuggcagauccucugcccuuuga

SEQ ID NO: 28292 - RNA, 1620 nt, Artificial Sequence
  derived and/or modified sequence opt5 from capsid_protein__Norovirus__BAF74513
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaagcaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccugucccccuugagaagcuguacaccgggccguccagcgccuucgugguucagccucagaacggacgguguacaaccgauggcgugcuccuggggacgacacaacugucugccgucaauauuugcaccuuccgcggagacgugacacauaucgcuggcucccacgauuauaccaugaaccucgcgagccagaauuggaacaauuacgaccccaccgaggaaaucccugcuccccugggcacaccugacuuugucgggaaaauucagggagugcuuacgcagaccacaagagaggauggcuccacccgggcccauaaggccacaguuucuaccgggagcgugcacuucacgcccaagcugggauccguccaauacacaaccgacaccaacaaugauuuucagacaggccagaacaccaaauucacaccgguggggguuauccaagacggaagcaaucaccagaacgaaccucagcagugggugcuccccaauuauucuggccgcacgggccauaacguccaccuggcccccgcuguggccccuaccuuuccgggggagcaacuucuguucuuuagauccacaaugcccggauguagcggcuacccuaauaugaaccucgauugccugcugccccaggaaugggugcagcauuucuaucaggaggcggcuccugcccaaucugacguugcccuccugcgguuugucaaccccgauaccgggcgcgugcuuuucgaguguaagcugcacaaaagcggauacgugacagucgcucacaccggcccucaugaccucgugauucccccgaauggguauuuuagauucgauuccuggguuaaccaguuuuacacgcuggccccuaugggcaauggagcuggccggagacgcgcccuuuga

SEQ ID NO: 28293 - RNA, 1623 nt, Artificial Sequence
  derived and/or modified sequence opt5 from capsid_protein__Norovirus__BAF74514
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacacuccgcggcgaugucacccauaucgccggcacccacaauuacacaaugaaccuggcuucucagaauuggaacaauuaugaccccacggaagagauuccugcgccccuugggaccccggauuuugugggaagaauccagggcguccugacacagaccacacgcggggacggauccacccggggccauaaagccacggugagcacaggggacguucacuucaccccuaagcucggaucugugcaauuuaacaccgauacaaauaacgacuucgaaauuggccagaauaccagauuuacacccgucggcgugguucaggaugggaacggaacgcaccaaaaugagccccagcagugggugcugccuuccuacagcggccggaccgggcauaacguccaccuugcuccggccguggcccccacauucccuggagaacagcugcucuuuuuccgcuccaccaugcccggcuguucuggguacccuaacaugaaucuggacugccugcucccccaagagugggugcagcauuuuuaucaggaggcugccccugcgcagagcgauguugcucugcuuagauucgucaaccccgacacaggccgggugcuguuugaauguaagcuccacaaauccggauacgugaccgucgcccacacgggccaacaugaucuggugaucccgccuaauggguauuucagauuugacagcuggguuaaccaguucuacacccuugcccccaugggaaauggcacagggcgccggagagcucuguga

SEQ ID NO: 28294 - RNA, 1620 nt, Artificial Sequence
  derived and/or modified sequence opt5 from capsid_protein__Norovirus__BAF74515
augaagauggccagcaacgacgcuaaucccuccgauggcucugccgcgaaccuggugccugaggucaauaacgaaguuauggcucucgagccgguggugggggccgccaucgcugcccccgucgcuggacagcaaaauauuaucgacccuuggauuagaaacaauuucgugcaggcccccggcggggaauuuaccguuagcccucggaacgcgcccggagagauccugugguccgccccucuuggcccggaucugaaucccuaccucucucaccugagccgcauguauaacggguacgcuggaggcuucgaagugcaggucauucuugccggcaaugcuuuuacagccgggaaagugaucuucgcggccguuccucccaacuuuccuacggagggacugucccccucucaggugaccauguucccgcauaucauugucgacgugagacaacucgagccugugcugaucccccugccugauguccggaauaacuuuuaucacuacaaucaggcucaugacagcacacucaagcugauugccaugcuuuauacaccccugcgcgcuaacaacgccggcgaugacguuuucaccguguccugcagagugcucacccggcccagcccugauuuugacuucaucuuucuggucccgcccacaguggaaucucgcaccaaaccuuucacgguucccgugcuuaccgucgaggaaaugacaaauuccagauuuccuauuccccuggagaagcucuacaccgggccgagcucugccaucgugguucagccucagaacggacgguguacaaccgauggcgugcugcuggggacgacacaacucuccgcugucaauauuugcaccuuccgcggagacgugacacacaucgcgggcagcagaaacuauaccaugaaucuggccucucagaacuggaauaacuacgaucccaccgaggaaaucccugcuccccuuggcacaccugacuucgucgggaaaauucagggacugcucacgcagaccacacgggccgacggcuccacccgcgcccauaaggcuacagugagcaccggguccguucacuuuacgcccaagcugggaucugugcaauucagcacagauaccgacaaugauuuucagccgggccagaacaccaaauucacaccugucggggugauccaagacggagauagacaccagaaugagccccagcaguggguucuucccgacuuuuccggccggaccggccauaacgugcaccuggccccugcggucgcuccgacauuccccggggaacaacuccuguuuuuccgcagcacgaugccuggaagaucuggcuaccccaauaugaaccuggauugucuccugccucaggagugggugcuucauuuuuaucaggaauccgcccccgcccagagcgacguggcucugcuccgguucguuaauccugauaccaacagaguccuguuugagugcaagcuccacaaaucuggguacauuacaguggcccacaccggacaucacgaccugauccuucccccgaacggcuauuuccgcuuugauagcugggugaaucaauucuacacacuggcuccuauggggaacggcgccggacggagacgcgcgcccuga

SEQ ID NO: 28295 - RNA, 1623 nt, Artificial Sequence
  derived and/or modified sequence opt5 from capsid_protein__Norovirus__BAF74516
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugguucuugccggcaacgcuuuuaccgccgggaaaaucauuuucgcggccgugccucccaauuuuccuacagagggacugagccccucccaggucaccauguucccgcauaucaucguggacgugagacaacucgagccuguccugauuccccugccugauguucggaacaaucucuaucacuacaaccagucuaaugaccccacaaucaagcugauugcuaugcuuuauacaccccugcgcgccaacaacgcuggcgaagauguguuuaccgugagcugcagaguccucacccggccuuccccggacuucgauuuuaucuuccuggugcccccuacgguugagagccgcaccaaacccuuuacagugccuauucuuaccggggaagagaugacaaauucuagauuccccaucccgcuggagaagcucuuuaccggaccuuccggcgccuucgucgugcagccccagaacgggcgguguacgacagacggaguucugcugggcaccacacaacuccugccugugaauauuugcaccuuccgcggcgaugucacccauaucgccgggacacacaacuacacgaugaaucuugcuagccagaacuggaauaacuaugaccccaccgaagagaucccugcgccccugggaacaccggauuuugugggccggauucaggggaugcucacccagacaaccagaggagacggcucuacgcgcgggcauaaagccacagucuccaccggagacgugcacuucaccccuaagcugggcagcauccaauuuaauacagauaccaacaaugacuucgaaacaggccagaacacgaaguuuacccccguuggggugguccaggauggaaauggcacacaccaaaacgagccccagcagugggugcuuccuucuuacuccgggagaaccagccauaauguucaccuggcuccggccguggcccccacauucccuggagaacagcuccuguuuuuccgguccaccaugcccggcuguucuggguacccuaacaugaaccuggacugccuccugccccaagaguggguccagcauuuuuaucaggaggcugccccugcgcagagcgauguggcccuucugcgcuucgugaaucccgacacgggcagaguucucuuugaauguaaacugcacaaguccggauacgucaccguggcucacacaggccaacaugaucuugugauuccgccuaacggguauuuccgguuugacagcugggucaaucaguucuacacccuggcccccaugggaaacggcacagggagacgccgggcucucuga

SEQ ID NO: 28296 - RNA, 1623 nt, Artificial Sequence
  derived and/or modified sequence opt5 from capsid_protein__Norovirus__BAF74517
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcacccacaauuacaccaugaaccucgcgucccagaauuggaacaauuaugacccuacagaagagauucccgccccucuggggacgcccgauuucgugggaagaauccagggcaugcuuacccagacaacccgcggggacggaagcacacggggccauaaagcuaccgucucuacgggggacgugcacuuuacaccgaagcugggauccauucaauucaacaccgauaccaauaacgacuuugaaacaggccagaauaccaaguucacaccuguuggcgugguccaggaugggaacggagcccaccaaaaugagccccagcagugggugcuccccagcuacuccggcagaacggggcauaacguucaccuggccccugcuguggccccgaccuuucccggagaacagcuucuguucuuucggucuacaaugccuggcuguagcggguaccccaacaugaaucucgacugccugcugccucaagaguggguccagcauuucuaucaggaggcggcucccgcccaguccgauguggcccuccugcgcuuugugaacccugacaccggcagaguucuuuucgaauguaaacugcacaagagcggauacgucacaguggcucacaccggccaacaugaucucgugauucccccgaauggguauuuucgguucgacucuugggucaaccaguucuacacgcuggccccuaugggaaauggcaccgggagacgccgggcucuuuga

SEQ ID NO: 28297 - RNA, 1623 nt, Artificial Sequence
  derived and/or modified sequence opt5 from capsid_protein__Norovirus__BAF74518
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuguucaauucaacaccgauacaaauaacgacuuugaaaccggccagaauacaagauucacgcccgugggcgucgugcaggaugggaacggaacccaccaaaaugagccccagcaguggguucucccuuccuacagcggccggacagggcauaacgugcaccuggcuccggccgucgcccccaccuuuccuggagaacagcuucuguucuuucgcuccacaaugcccggcuguucuggguacccuaacaugaaucucgacugccugcugccccaagagugggugcagcauuucuaucaggaggcugccccugcgcagagcgauguggcucuccugagauuuguuaaccccgacaccggccggguccuuuucgaauguaagcugcacaaauccggauacgugacgguggcccacaccggccaacaugaucucgucauuccgccuaauggguauuuuagauucgacagcugggugaaccaguucuacacacuggcccccaugggaaauggcaccgggcgccggagagcucuuuga

SEQ ID NO: 28298 - RNA, 1623 nt, Artificial Sequence
  derived and/or modified sequence opt5 from capsid_protein__Norovirus__BAF74519
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaagauguuuucaccgugagcugcagagugcugacccggccuuccccggacuuugauuucauuuuucucgugcccccuacggucgagagccgcaccaaacccuucacaguuccuauccugaccguggaagagaugacaaauucuagauuucccauuccgcuugagaagcuguucaccgggccuuccggagccuucgucgugcagccccagaacggccgguguacgacagacgggguucuccugggaaccacacaacugagcccugugaauaucugcaccuuucgcggcgaugucacccauaucgccggcacacacaacuacacgaugaaucucgcuucucagaacuggaauaacuaugaccccaccgaagagauuccugcgccccuggggacaccggauuucgugggaagaauccagggcaugcuuacccagacaacccgcggggacggauccacgcggggccauaaagccacagucagcaccggggacgugcacuuuaccccuaagcugggaucuauucaauucaauacagauaccaacaaugacuuugaaacaggccagaacacgaaguucacccccguuggcgugguccaggaugggaauggaacacaccaaaacgagccccagcagugggugcucccuuccuacagcggcagaaccgggcauaauguucaccuggcuccggccguggcccccacauuuccuggagaacagcuucuguucuuucgguccaccaugcccggcuguucuggguacccuaacaugaaccucgacugccugcugccccaagaguggguccagcauuucuaucaggaggcugccccugcgcagagcgauguggcucuccugcgcuuugugaaucccgacacgggcagaguucuuuucgaauguaaacugcacaaguccggauaccucaccgucgcccacacaggccaacaugaucuggugaucccgccuaacggguauuuucgguucgacagcugggugaaucaguucuacacccuugcccccaugggaaacggcacagggagacgccgggcucuguga

SEQ ID NO: 28299 - RNA, 1623 nt, Artificial Sequence
  derived and/or modified sequence opt5 from capsid_protein__Norovirus__BAF74520
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugauccaggaugggaacggagcucaccaaaaugagccccagcaguggguccucccuuccuacagcggcagaaccgggcauaacgugcaccuggccccggccguugcucccacauuuccuggagaacagcuucuguucuuucgguccaccaugcccggcuguucuggguacccuaacaugaaucucgacugccugcugccccaagagugggugcagcauuucuaucaggaggccgcgccugcucagagcgaugucgcccuccugcgcuuugugaaccccgacacaggcagagugcuuuucgaauguaaacugcacaaguccggauacauuaccguugcccacacgggccaacaugaucucgucaucccgccuaauggguauuuucgguucgacagcugggugaaccaguucuacacccuggcucccaugggaaauggcacagggagacgccgggcccuuuga

SEQ ID NO: 28300 - RNA, 1623 nt, Artificial Sequence
  derived and/or modified sequence opt5 from capsid_protein__Norovirus__BAF74521
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccagcuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaagauguuuucaccguguccugcagagugcugacacggccuagcccggacuuugauuucauuuuucucgugcccccuaccgucgagucucgcacgaaacccuucaccguuccuauccugacaguggaagagaugaccaauuccagauuucccauuccgcuugagaagcuguucacagggccuagcggagccuucgucgugcagccccagaacggccgguguaccacggacgggguucuccugggaacaacccaacugucuccugugaauaucugcacauuucgcggcgaugucacccauaucgccggcacccacaacuacacaaugaaucucgcuucccagaacuggaauaacuaugaccccacggaagagauuccugcgccccuggggaccccggauuucgugggaagaauccagggcaugcuuacacagaccacacgcggggacggaagcacccggggccauaaagccacggucucuacaggggacgugcacuuuaccccuaagcugggauccauucaauucaauaccgauacaaacaaugacuuugaaaccggccagaacacaaaguucacgcccguuggcgugguccaggaugggaauggaacccaccaaaacgagccccagcagugggugcucccuagcuacuccggcagaacagggcauaauguucaccuggcuccggccguggcccccaccuuuccuggagaacagcuucuguucuuucggucuacaaugcccggcuguagcggguacccuaacaugaaccucgacugccugcugccccaagaguggguccagcauuucuaucaggaggcugccccugcgcaguccgauguggcucuccugcgcuuugugaaucccgacaccggcagaguucuuuucgaauguaaacugcacaagagcggauacgucacgguggcccacaccggccaacaugaucucgugaucccgccuaacggguauuuucgguucgacucuugggucaaucaguucuacacacuggcccccaugggaaacggcaccgggagacgccgggcucuuuga

SEQ ID NO: 28301 - RNA, 1623 nt, Artificial Sequence
  derived and/or modified sequence opt5 from capsid_protein__Norovirus__BAF74522
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccagcuuuccuacagagggacugucccccucucaggugaccauguucccgcauaucauugucgacgugagacaacucgagccugugcugaucccccugccugauguccggaauaacuuuuaucacuacaaucagagcaacgaccccacaauuaagcucaucgcuaugcuguauacaccccuucgcgccaauaacgcuggcgaagauguuuucaccguguccugcagagugcugacccggccuagcccggacuuugauuucauuuuucucgugcccccuacggucgagucucgcaccaaacccuucacaguuccuauccugaccguggaagagaugacaaacuccagauuucccauuccgcuugagaagcuguucaccgggccuagcggagccuucgucgugcagccccagaauggccgguguacgacagacgggguucuccugggaaccacacaacugucuccugugaacaucugcaccuuucgcggcgaugucacccauaucgccggcacacacaauuacacgaugaaccucgcuucccagaauuggaacaauuaugaccccaccgaagagauuccugcgccccuggggacaccggauuucgugggaagaauccagggcaugcuuacccagacaacccgcggggacggaagcacgcggggccauaaagccacagucucuaccggggacgugcacuuuaccccuaagcugggauccguucaauucgauacagacaccaacagcgauuuugaaacaggccagaauacgaaguucacccccgugggcgucgugcaggacgggaacggagcucaccaaaaugagccccagcaguggguucucccuuccuacucuggcagaacagggcauaacgcccaccuggccccggcuguggcccccaccuuuccuggagaacagcuucuguucuuucggagcacaaugcccggcuguuccggguacccuaauaugaaccucgauugccugcugccccaagaguggguccagcauuucuaucaggaggcggcuccugcccagagcgacguggcccuccugcgcuuugugaaucccgauaccggcagaguucuuuucgaauguaaacugcacaagucuggauacgucacgguggcucacaccggccaacaugaccucgugauuccgccuaacggguauuuucgguucgauuccugggucaaccaguucuacacacuggcccccaugggaaauggcaccgggagacgccgggcucuuuga

SEQ ID NO: 28302 - RNA, 1623 nt, Artificial Sequence; identical to SEQ ID NO: 26947
  derived and/or modified sequence opt5 from capsid_protein__Norovirus__BAF74523

SEQ ID NO: 28303 - RNA, 1623 nt, Artificial Sequence; identical to SEQ ID NO: 26947
  derived and/or modified sequence opt5 from capsid_protein__Norovirus__BAF74524

SEQ ID NO: 28304 - RNA, 1623 nt, Artificial Sequence; identical to SEQ ID NO: 26947
  derived and/or modified sequence opt5 from capsid_protein__Norovirus__BAF74525

SEQ ID NO: 28305 - RNA, 1623 nt, Artificial Sequence
  derived and/or modified sequence opt5 from capsid_protein__Norovirus__BAF74526
augaagauggccagcaacgacgcuacccccuccgauggcucuacagccaaucuggugccugaggucaacacggaaguuauggcgcucgagccgguggugggggcugccaucgccgcucccgucgccggacagcaaaaugugauugacccuuggaucagaaacaauuucguucaggcucccggcggggaauuuaccgugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacagccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcaccaauaacgccggcgaugacguuuucacggugagcugcagagugcugacccggccuuccccggauuuugacuucauuuuucucgugcccccuacagucgaaagccgcaccaaacccuucucuguuccuauccugacaguggaggaaaugaccaacuccagauuucccauuccgcuugagaagcuguucacggggccuagcucugcuuucgucgugcagccccagaauggacgguguacaaccgauggcguucuccuggggacaacccaacuguccccugugaacaucugcaccuuucgcggagacgucacacauaucgccggcacgcagaauuacaccaugaaccucgccagccagaauuggaacaauuaugaucccacagaggaaauuccugcuccccugggcaccccggacuucguggggaaaauccagggaguccuuacacaaaccacgagacgggacggcucuacacgcgggcacaaggcgaccguguccaccggaagcauucauuuuacaccuaagcugggcuccguucaguucucuaccgauacaagcaacgacuuugagacggggcagaauaccagauucacacccgugggagucgugcaagauggcuccaccacacaccagaacgaaccccagcaguggguucucccugacuacagcggccgggauucucacaaugugcaucuggccccggcugucgcccccaccuuuccuggggagcaacuucuguucuuucgcuccacgaugcccggauguagcggcuacccuaacaugaaucucgacugccugcugccccaggaaugggugcagcacuucuaucaggagucugccccugcucaaagcgauguggcccuccugagauuuguuaaccccgacaccgggcggguccuuuucgaguguaaacugcauaaguccggauacgugacaguggcgcacaccggccagcacgaucucgucaucccgccuaauggguauuuuagauucgacucuugggugaaccaguucuacacacuggcucccaugggcaacggagccggccgccggagagcccuuuga

SEQ ID NO: 28306 - RNA, 1623 nt, Artificial Sequence
  derived and/or modified sequence opt5 from capsid_protein__Norovirus__BAF74527
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcauucauuuuaccccuaagcugggcuccguucaguucucuaccgauacaagcaaugacuuugagaccgggcagaacacaagauucacgcccgugggagucgugcaagauggcuccaccacacaccagaaugaaccccagcaguggguucucccugacuacagcggccgggauucucacaacgugcaucuggcuccggccgucgcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguggcgcuccugagauuuguuaaucccgacaccgggcggguccuuuucgaguguaaacugcauaaguccggauacgugacgguggcucacaccggccagcacgaucucgucaucccgccuaacggguauuuuagauucgacucuugggugaaccaguucuacacacuggcccccaugggcaauggagccggccgccggagagcucuuuga

SEQ ID NO: 28307 - RNA, 1620 nt, Artificial Sequence
  derived and/or modified sequence opt5 from capsid_protein__Norovirus__BAF95499
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaugacguuuucaccguguccugcagagugcugacacggcccagcccugauuuugacuucauuuuucucgucccgcccaccguggaaucucgcacgaaaccuuucaccguucccauccugacaguggaggaaauguccaacagcagauuuccugucccccuugagaagcuguacaccgggccgucuuccgccuucgugguucagccucagaauggacgguguacaaccgauggcgugcuccuggggacgacacaacugagcgccgucaacauuugcaccuuccgcggagacgugacacauaucgcuggcucucacgauuauaccaugaaucucgcgucccagaacuggaauaacuacgaccccaccgaggaaaucccugcuccccugggcacaccugacuuugucgggaaaauucagggagugcuuacgcagaccacaagagaggauggcagcacccgggcccauaaggccacaguuuccaccgggucugugcacuucacgcccaagcugggaagcguccaauacacaaccgacaccaauaacgauuuucagacaggccagaauaccaaauucacaccgguggggguuauccaagacggauccaaccaccagaaugaaccucagcagugggugcuccccaacuauagcggccgcacgggccauaauguccaccuggcccccgcuguggccccuaccuuuccgggggagcaacuucuguucuuuagaucuacaaugcccggauguuccggcuacccuaacaugaaccucgauugccugcugccccaggaaugggugcagcauuucuaucaggaggcggcuccugcccaaagcgacguugcccuccugcgguuugucaaucccgauaccgggcgcgugcuuuucgaguguaagcugcacaaaucuggauacgugacagucgcucacaccggcccucaugaccucgugauucccccgaacggguauuuuagauucgauagcuggguuaaucaguuuuacacgcuggccccuaugggcaacggagcuggccggagacgcgcccuuuga

SEQ ID NO: 28308 - RNA, 1620 nt, Artificial Sequence
  derived and/or modified sequence opt5 from capsid_protein__Norovirus__BAF95501
augaagauggccagcaacgacgugaaucccuccgauggcucugcugccaaccuggucccugagguuaauaacgaagugauggcgcucgagccgguggucggggcugccaucgccgcucccguggccggacagcaaaauauuaucgacccuuggauuagaaacaauuucguucaggcucccggcggggaauuuaccgugagcccucggaacgcccccggagagauccugugguccgcgccucuuggcccggaucugaaucccuaccucucucaccugagccgcauguauaacggguacgccggaggcuucgaaguccaggugauucuugcuggcaaugccuuuacagcugggaaaguuaucuucgccgcggugccucccaacuuuccuacggagggacugucccccucucaggucaccauguucccgcauaucauuguggacgugagacaacucgagccuguccugaucccccugccugauguucggaauaacuuuuaucacuacaaucaggcccaugacagcacacucaagcugauugcuaugcuuuauacaccccugcgcgccaacaacgcuggcgaugacguguucaccguguccugcagaguccucacccggcccagcccugauuuugacuucaucuuucuggugccgcccacaguugaaucucgcaccaaaccuuucacggugcccguccuuaccguggaggaaaugacaaauuccagauuuccuauuccccuggagaagcucuacaccgggccgagcucugccuucguugugcagccucagaacggacgguguacaaccgauggcguccugcuggggacgacacaacucuccgccgugaauaucugcaccuuccgcggagacgucacacacauugcuggcagcagaaacuauaccaugaaucuggcgucucagaacuggaauaacuacgaucccaccgaggaaaucccugcuccccuuggcacaccugacuuuguggggaaaauccagggacugcucacgcagaccacacgggccgacggcuccacccgcgcccauaaggccacaguuagcaccggguccgugcacuucacgcccaagcugggaucuguccaauuuagcacagauaccgacaaugauuuccagccgggccagaacaccaaauuuacaccuguggggguuauucaagacggagauagacaccagaaugagccccagcagugggugcuucccgacuacuccggccggaccggccauaacguccaccuggcuccugccguggcgccgacauuccccggggaacaacuccuguuuuuccgcagcacgaugccuggauguucuggcuaucccaauaugaaccuggauugccuccugccucaggagugggugcuucauuuuuaccaggaauccgcucccgcccagagcgacguugcccugcucagauucgucaauccugauaccaaccgggugcuguuugaguguaagcuccacaaaucuggguauaucacaguggcucacaccggacaacaugaccugauucuucccccgaacggcuacuucagauuugauagcugggucaaucaguucuauacacuggccccuauggggaacggcgcuggacgccggagagcccccuga

SEQ ID NO: 28309 - RNA, 1623 nt, Artificial Sequence
  derived and/or modified sequence opt5 from capsid_protein__Norovirus__BAF95503
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacaaaaggggacggauccacccggggccauaaggccacggucagcacaggggacgugcacuuuaccccuaagcugggaucuauucaauucaacaccgauacaaauaacgacuuugaaaccggccagaauacaaaauucacgcccguuggcgugguccaggaugggaacggaacccaccaaaaugagccccagcagugggugcucccuuccuacagcggccgcacagggcauaacguucaccuggcuccggccguggcccccaccuuuccuggagaacagcuucuguucuuuagauccacaaugcccggcuguucuggguacccuaacaugaaucucgacugccugcugccccaagaguggguccagcauuucuaucaggaggcugccccugcgcagagcgauguggcucuccugcgguuugugaaccccgacaccggccgcguucuuuucgaauguaagcugcacaaauccggauacgucacgguggcccacaccggccaacaugaucucgugaucccgccuaauggguauuuuagauucgacagcugggucaaccaguucuacacacuggcccccaugggaaauggcaccgggcggagacgcgcucuuuga

SEQ ID NO: 28310 - RNA, 1623 nt, Artificial Sequence
  derived and/or modified sequence opt5 from capsid_protein__Norovirus__BAF95505
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccugugcugacagucgaagagaugaccaacucuagauuucccaucccgcuugagaagcuguucacagggccuuccggagccuucgugguucagccccagaauggccgguguaccacggacggggugcuccugggaacaacccaacugagcccugucaacauuugcacauuucgcggcgaugugacccauaucgccggcacccacaauuacacaaugaaccucgcuucucagaauuggaacaauuaugaccccacggaagagaucccugcgccccuggggaccccggauuucgucggacggauucagggcaugcuuacacagaccacaaaaggggacggauccaccagaggccauaaggccacggugagcacaggggacguucacuuuaccccuaagcugggaucuauccaauucaacaccgauacaaauaacgacuuugaaaccggccagaauacaaaauucacgcccgugggcgucgugcaggaugggaacggaacccaccaaaaugagccccagcaguggguucucccuuccuacagcggccgcacagggcauaacgugcaccuggcuccggccgucgcccccaccuuuccuggagaacagcuucuguucuuuagauccacaaugcccggcuguucuggguacccuaacaugaaucucgacugccugcugccccaagagugggugcagcauuucuaucaggaggcugccccugcgcagagcgauguggcucuccugcgguuuguuaaccccgacaccggccgcguccuuuucgaauguaagcugcacaaauccggauacgugacgguggcccacaccggccaacaugaucucgucauuccgccuaauggguauuuuagauucgacagcugggugaaccaguucuacacacuggcccccaugggaaauggcaccgggcggagacgcgcucuuuga

SEQ ID NO: 28311 - RNA, 1623 nt, Artificial Sequence; identical to SEQ ID NO: 28284
  derived and/or modified sequence opt5 from capsid_protein__Norovirus__BAF95507

SEQ ID NO: 28312 - RNA, 1623 nt, Artificial Sequence
  derived and/or modified sequence opt5 from capsid_protein__Norovirus__BAF95509
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagaggcgacgggucuacccggggacacaaggccacgguguccacaggcagcguucauuuuaccccuaagcugggguccgugcaguucucuaccgauacaagcaaugacuuugagaccggacagaacacacgcuucacgcccgucggcgugguucaagauggcuccaccacacaccagaaugaaccccagcagugggugcucccuaacuacagcgggagagacucucacaauguccaucuggcuccggccguggcccccaccuuuccuggagagcaacuucuguucuuucgguccacaaugcccggcuguagcggguacccuaacaugaaucucgauugccugcugccccaggaaugggugcagcacuucuaucaggagucugcuccugcccaaagcgacguugcgcuccugcgcuuugucaaccccgauaccggaagagugcuuuucgaguguaaacugcauaaguccggcuacgugacggucgcucacaccgggcagcacgaccucgugauuccgccuaacggcuauuuucgguucgauucuuggguuaaucaguucuacacacuggcccccaugggaaacggcgccgggagacgccgggcucuuuga

SEQ ID NO: 28313 - RNA, 1623 nt, Artificial Sequence; identical to SEQ ID NO: 26969
  derived and/or modified sequence opt5 from capsid_protein__Norovirus__BAF95511

SEQ ID NO: 28314 - RNA, 1623 nt, Artificial Sequence
  derived and/or modified sequence opt5 from capsid_protein__Norovirus__BAF95513
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaagacgggacggcuccacccgcgggcacaaggccacggugagcacaggauccguucauuuuaccccgaagcugggcucugugcaguucagcaccgauacauccaaugacuuugagaccgggcagaacacaagauucacgccugucggagugguucaagauggcagcaccacacaccagaaugaaccccagcagugggugcuccccaacuacucuggccgggacucccacaauguccaucuggcuccugccguggccccgaccuuucccggggagcaacuucuguucuuucgcagcacaaugccuggauguucuggcuaccccaacaugaaucucgauugccugcugccucaggaaugggugcagcacuucuaucaggagagcgcucccgcccaauccgacguugcgcuccugagauuugucaacccugauaccgggcgggugcuuuucgaguguaaacugcauaagucuggauacgugacggucgcucacaccggccagcacgaccucgugauucccccgaacggguauuuuagauucgauagcuggguuaaucaguucuacacacuggccccuaugggcaacggagccggccgccggagagcucuuuga

SEQ ID NO: 28315 - RNA, 1623 nt, Artificial Sequence; identical to SEQ ID NO: 26795
  derived and/or modified sequence opt5 from capsid_protein__Norovirus__BAF95515

SEQ ID NO: 28316 - RNA, 1623 nt, Artificial Sequence
  derived and/or modified sequence opt5 from capsid_protein__Norovirus__BAF95517
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaugacguuuucaccgugagcugcagagugcugacccggcccucuccugauuuugacuucauuuuucucgucccgcccacaguggaaucccgcaccaaaccuuucacgguucccauccugaccguggaggaaaugacaaauagcagauuuccuauuccccuugagaagcuguucaccgggccgucuuccgccuucgucgugcagccucagaacggacgguguacaaccgauggcguucuccuggggacgacacaacugagccccgugaauaucugcaccuuucgcggagacgucacacauaucucuggcaccagaaccuaccggaugaaccucgcuucccagaauuggaacaauuaugauccuacagaggaaauucccgcgccucugggcacgcccgacuucguggggaaaauccagggaaugcuuacccagacaaccaagggcgacgggagcacacgcggacacaaggccaccgucuccacgggcucuguggauuuuacaccgaaacuggggagcguucaauucgcuaccgacaccgauaacgacuuugagacaggacagaauaccagauucacaccugugggcgucauucaggauggcuccagcgcccaucggaacgaaccccaacagugggugcuccccgacuacucugggcgcacgguucacaaugugcaccuggccccugcugucgccccgaccuuucccggagagcagcuucuguucuuuagauccacaaugccuggcuguagcggguaccccaacauggaucucgacugccugcugccucaggaaugggugcaacauuucuaucaggaggcggcucccucucagagcgauguggcccuccugcgguuuguuaauccugacaccggaagaguccuuuucgaguguaagcugcacaaagccggcuacgugacaguggcucauaccgggcagcacgaucucgucauucccccgaacggcuauuuucgcuucgacuccugggugaaucaauucuacacgcuggccccuaugggaaacggcgcugggcggagacgcgcccuuuga

SEQ ID NO: 28317 - RNA, 1623 nt, Artificial Sequence
  derived and/or modified sequence opt5 from capsid_protein__Norovirus__BAF95519
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucaucgcuaugcuguauacaccccuucgcgccaacaacgcuggcgaugacguuuucaccguguccugcagagugcugacccggcccagcccugauuuugacuucauuuuucucgucccgcccacgguggaaucucgcaccaaaccuuucuccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucgccggcacccagaacuacacaaugaaucucgcuucucagaacuggaauaacuaugauccuacggaggaaauucccgcgccucugggcacccccgacuucguggggaaaauccagggaguccuuacacaaaccacaaccagagacggcuccacgcgggggcacaaggccacagugagcaccggauccguucauuuuaccccgaagcugggcucugugcaguucagcacagauaccuccaaugacuuugagacagggcagaacacgcgcuucaccccugucggagugguucaagauggcagcacaacccaccagaaugaaccccagcagugggugcuccccgacuacucuggcagagauucccacaacguccaucuggcuccugccguggccccgacauuucccggggagcaacuucuguucuuucggagcaccaugccuggauguucuggcuaccccaauaugaaccucgacugccugcugccucaggaaugggugcagcacuucuaucaggagagcgcucccgcccaauccgauguugcgcuccugcgcuuugucaauccugacacggggagagugcuuuucgaguguaaacugcauaagucuggauacgugaccgucgcucacacaggccagcacgaucucgugauucccccgaacggguauuuucgguucgacagcuggguuaaccaguucuacacccuggccccuaugggcaauggagccggcagacgccgggcucuuuga

SEQ ID NO: 28318 - RNA, 1623 nt, Artificial Sequence
  derived and/or modified sequence opt5 from capsid_protein__Norovirus__BAF95521
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaggcacgacccaccagaacgagccccagcaguggguucucccuaauuacagcggccgcgacucucacaacgugcaucuggcuccggccgucgcccccuccuuuccuggggaacaacuucuguucuuuagaagcacaaugcccggauguucuggcuacccuaauaugaaccucgauugccugcugccccaggagugggugcagcacuucuaucaggaggcugccccugcgcaaagcgacguggcucuccugcgguuuguuaaucccgauaccgggagaguccuuuucgaauguaaacugcauaaguccggauacgugacaguggcccacaccggccagcacgaccucgucaucccgccuaacggguauuuucgcuucgauucuugggugaaccaguucuacacgcuggcccccaugggcaauggaaccggccggagacgcgcucuuuga

SEQ ID NO: 28319 - RNA, 1623 nt, Artificial Sequence; identical to SEQ ID NO: 27495
  derived and/or modified sequence opt5 from capsid_protein__Norovirus__BAF95523

SEQ ID NO: 28320 - RNA, 1623 nt, Artificial Sequence; identical to SEQ ID NO: 26795
  derived and/or modified sequence opt5 from capsid_protein__Norovirus__BAF95525

SEQ ID NO: 28321 - RNA, 1623 nt, Artificial Sequence
  derived and/or modified sequence opt5 from capsid_protein__Norovirus__BAF95527
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgacguccaggugauccuugccggcaacgcuuuuacggccgggaaaauuaucuucgcggccguuccucccaauuuuccuaccgaaggacugucccccucucaggugacaauguucccgcauaucauugucgaugugagacaacucgagccugugcugaucccccugccugacguccggaacaauuuuuaucacuacaaccagagcaaugauuccaccauuaagcucaucgcuaugcuguauacaccccuucgcgccaacaacgcuggcgacgauguuuucaccgugagcugcagagugcugacacggcccucuccugacuuugauuucauuuuucucgucccgcccaccguggagucccgcacgaaaccuuucaccguucccauccugacaguggaagagaugaccaauagcagauuuccuauuccccuugaaaagcuguucacagggccgucuuccgccuucgucgugcagccucagaacggacgguguaccacggacggcguucuccuggggacaacccaacugagccccgugaauaucugcacauuucgcggagaugucacccauaucccuggcaccagaacauaccggaugaaccucgccucucagaauuggaacaauuaugaccccacggaggagauuccugcuccccugggcaccccggacuucguggggaaaauccagggaaugcuuacacagaccacaaagggcgauggguccacccgcggacacaaggcgacggucagcacaggcuccguggacuuuaccccuaaacuggggucuguucaauucgccaccgauacagacaacgauuuugaaaccggacagaauacaagauucacgcccgugggcgucauucaggacggcagcuccacccaucggaacgagccccaacagugggugcucccugauuacagcgggcgcacaguucacaaugugcaccuggcuccggccgucgcccccaccuuuccuggagaacagcuucuguucuuuagaucuacaaugcccggcuguuccggguacccuaacauggaccucgauugccugcugccccaggagugggugcaacauuucuaucaggaagcugccccuagccagucugacguggcgcuccugcgguuuguuaaucccgauaccggaagaguccuuuucgaguguaagcugcacaaagcuggcuacgugacgguggcccauaccgggcagcacgaccucgucaucccgccuaacggcuauuuucgcuucgacagcugggugaaucaauucuacacacuggcccccaugggaaacggcgcugggcggagacgcgcccuuuga

SEQ ID NO: 28322 - RNA, 1623 nt, Artificial Sequence
  derived and/or modified sequence opt5 from capsid_protein__Norovirus__BAF95529
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcaugcugacgcagaccacaaagggggacggaucuacccggggccacaaggcuacagucuacaccggguccgccccguuuacgccuaaacucggaagcgugcaguucuccacagacaccgaaaacgauuuugagacccaucaaaauacaaaguucacccccguuggcgugauucaggacggcucuacaacgcaccgcaacgaaccccagcaauggguccugccuagcuacuccgggagaaaugugcacaacguucaucuugccccggcuguggcccccaccuuuccuggagagcagcuccuguucuuucggagcacaaugcccggcuguucuggguauccuaauauggaucuggacugccugcucccccaggaguggguccagcacuucuaccaagaagcggcuccugcccaguccgauguggcccugcuucgcuuugugaaccccgacaccggaagaguucuguucgaguguaaacuccauaagagcggcuaugucacaguggcucacaccgggcagcacgaucuggugaucccgccuaacggcuacuuucgguucgacucuugggucaaucaguucuauacgcuugcccccaugggaaacggcaccgggagacgccgggcucuguga

SEQ ID NO: 28323 - RNA, 1623 nt, Artificial Sequence; identical to SEQ ID NO: 26932
  derived and/or modified sequence opt5 from capsid_protein__Norovirus__BAF95531

SEQ ID NO: 28324 - RNA, 1623 nt, Artificial Sequence; identical to SEQ ID NO: 27636
  derived and/or modified sequence opt5 from capsid_protein__Norovirus__BAG30923

SEQ ID NO: 28325 - RNA, 1629 nt, Artificial Sequence
  derived and/or modified sequence opt5 from capsid_protein__Norovirus__BAG34630
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcagaacgccgcugggcacaaugagccugccaaccggggacaugacgccgugguucccacauacacggcucaguacaccccgaaacugggccaaauucagaucgggacauggcagaccgaugaccugacagugaaucagccugucaaguucacccccgugggacucaacgauacggaacacuuuaaucaauggguugugccccgcuaugccggcgcgcugaaccuuaauacaaaccuggcuccuuccgucgccccgguguuccccggcgagagacuccuguuuuuccggagcuacaucccucuuaaagggggauauggcaaucccgccauugacugccugcucccucaggagugggugcagcauuuuuaccaggaagcugcccccuccaugucugagguugcucugguccgcuauaucaacccugauaccgggagagcccuguucgaagcgaagcuccaccgggccggauuuaugaccgugagcuccaacacaagcgcucccguggucgugccggccaauggcuacuucagauuugacucuuggguuaaccaauucuauucccuggcuccuauggggaccggcaauggacgccggagagugcaguga

SEQ ID NO: 28326 - RNA, 1629 nt, Artificial Sequence
  derived and/or modified sequence opt5 from capsid_protein__Norovirus__BAG34632
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguuuaccucccccaacgaggugaucagcguccagugucagaauggacggugcacgcuugacggcgaacugcaagggacaacccagcuccaggugucuggaauuuguguuuucaagggcgaggugacagcccaucugcacgauaacgaccaccuuuacaauaucaccauuaccaaccugaauggcuccccguucgacccuagcgaagauguccccgcuccucucggggugcccgacuuucagggacgcgucuucggcgugaucucucaaagagauaaccacaaugcguccgggcauaaccagccugccaaucggggacacgacgcuguugugcccacauauacggcccaguacaccccgaagcugggccaaauucagaucgggacauggcagaccgaugaccugacagucaaccagccugugaaauuuacccccguuggacucaaugauguggagcauuucaaccaaugggucgugccccgcuacgccggcgcucugaaucuuaacacgaaucuggccccuagcguggcgccgguuuuucccggcgaaagacuccuguucuuucgguccuaucuuccucugaaagggggauacggcaaccccgucaucgacugccuccugccucaggagugggugcagcacuucuaucaggaggcugcccccucuaugagcgaaguggcccugguccgcuacauuaacccugauacagggagagcucucuuugaggccaagcugcaccgggcuggauucaugaccguguccagcaauaccucugcccccguuguggucccggcgaacggcuauuuuagauucgacuccugggugaaucaauuuuacagccuugccccuauggggacaggcaacggacgccggagaauccaguga

SEQ ID NO: 28327 - RNA, 1629 nt, Artificial Sequence
  derived and/or modified sequence opt5 from capsid_protein__Norovirus__BAG34634
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcagcccguucgacccuucugaagauauucccgcgccucucgggguccccgacuuccagggacgcguguuuggcgucaucucccaaagagauaagcacaaugccagcgggcauaacgagccugcuaaucggggacacgacgccgugguucccacauacacggcccaguacaccccgaaacugggccagauucaaaucgggacauggcagaccgaugaccugacagugaaccagccugucaaguucacccccgugggacucaaugauacggaacauuuuaaccaguggguugugccccgcuaugcuggcgcccugaaucuuaacacaaaucuggcgccuuccgucgcuccgguguuccccggcgagagacuccuguuuuuccggucuuacaucccucuuaaagggggauauggcaaccccgccauugacugccugcucccucaagagugggugcagcacuuuuaccaggaagccgcucccagcauguccgagguugcccugguccgcuauaucaauccugauaccgggagagcucuguucgaagccaagcuccaccgggcgggauuuaugaccgugagcucuaacacauccgcccccguggucgugccggcuaacggcuacuucagauuugacagcuggguuaaucaguucuauucucuggccccuauggggaccggcaacggacgccggagagugcaauga

SEQ ID NO: 28328 - RNA, 1629 nt, Artificial Sequence
  derived and/or modified sequence opt5 from capsid_protein__Norovirus__BAG34636
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguuuaccucccccaacgaggugaucagcguccagugucagaauggacggugcacgcuugacggcgaacugcaagggucuacacagcuccagguguccggaauuugugccuucaagggcgagguuaccgcucaucugcacgauaacgaccaccuuuacaauaucacaauuaccaaccugaauggcagcccguucgacccuucugaagaugugcccgcgccucucgggguccccgacuuucagggacgcguguucggcgucaucucccaaagagauaaccacaaugccagcgggcauaaccagccugcuaaucggggacacgacgccgugguucccaccuauacaucccaguacacgccgaagcugggccaaauucagaucgggaccuggcagacagaugaccugaccgugaaccagccugucaaauuuacacccgugggacucaaugauguugagcauuucaaccaauggguggucccccgcuacgccggcgcucugaaucuuaacaccaaucuggccccuucuguggcgccgguguuucccggcgaaagacuccuguucuuucggagcuaucuuccucugaaagggggauacggcaaccccgcuaucgacugccuccugccucaggaguggguucagcacuucuaucaggaggccgcccccuccaugagcgaagucgcucuggugcgcuacauuaacccugauacggggagagcccucuuugaggcuaagcugcaccgggccggauucaugacagugucuuccaauaccagcgcgcccgucgugguuccggccaacggcuauuuuagauucgacucuugggugaaucaauuuuacagccuugcuccuauggggaccggcaacggacgccggagaauccaguga

SEQ ID NO: 28329 - RNA, 1629 nt, Artificial Sequence; identical to SEQ ID NO: 26868
  derived and/or modified sequence opt5 from capsid_protein__Norovirus__BAG34638

SEQ ID NO: 28330 - RNA, 1629 nt, Artificial Sequence; identical to SEQ ID NO: 26868
  derived and/or modified sequence opt5 from capsid_protein__Norovirus__BAG34640

SEQ ID NO: 28331 - RNA, 1629 nt, Artificial Sequence; identical to SEQ ID NO: 26868
  derived and/or modified sequence opt5 from capsid_protein__Norovirus__BAG34642

SEQ ID NO: 28332 - RNA, 1629 nt, Artificial Sequence; identical to SEQ ID NO: 26868
  derived and/or modified sequence opt5 from capsid_protein__Norovirus__BAG34644

SEQ ID NO: 28333 - RNA, 1629 nt, Artificial Sequence; identical to SEQ ID NO: 26868
  derived and/or modified sequence opt5 from capsid_protein__Norovirus__BAG34646

SEQ ID NO: 28334 - RNA, 1629 nt, Artificial Sequence
  derived and/or modified sequence opt5 from capsid_protein__Norovirus__BAG34648
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaaggguccacacagcuccaggugagcggaauuugugccuuuaagggcgagguuaccgcucaucugcacgauaaugaccaccuuuauaacgugacaaucaccaaucugaacggcucuccguucgacccuuccgaagauauucccgcgccucucgggguccccgacuuccagggacgcguguuuggcgucaucagccaaagagauaagcacaauuccccugggcauaacgagcccgccaaucggggacacgacgcugugguuccgaccuacacaucucaguacacgccuaaacugggccagauucaaaucgggaccuggcagacagaugaccugaccgugaaccagcccgucaaguucacacccgugggacucaaugauaccgaacauuuuaaccaguggguugugccucgcuaugccggcgcccugaaucuuaacacgaaucuggcuccgagcgucgcccccguguucccuggcgagagacuccuguuuuuccgguccuacaucccccuuaaagggggauauggcaacccugcgauugacugccugcucccccaagagugggugcagcacuuuuaccaggaagcugccccuagcaugucugagguugcccugguccgcuauaucaaucccgauacagggagagcucuguucgaagccaagcuccaccgggcuggauuuaugaccguguccagcaacaccucugccccgguggucgugccugcgaacggcuacuucagauuugacagcuggguuaaucaguucuauucccuggcccccauggggacaggcaacggacgccggagagugcaauga

SEQ ID NO: 28335 - RNA, 1629 nt, Artificial Sequence; identical to SEQ ID NO: 26868
  derived and/or modified sequence opt5 from capsid_protein__Norovirus__BAG34650

SEQ ID NO: 28336 - RNA, 1629 nt, Artificial Sequence
  derived and/or modified sequence opt5 from capsid_protein__Norovirus__BAG34652
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacaacuccccugggcauaaugagcccgccaaccggggacacgacgcugugguuccgacauacacgccucaguacacccccaaacugggccagauucaaaucgggacauggcagaccgaugaccugacagugaaucagcccgucaaguucaccccugugggacucaacgauacggaacauuuuaaucaguggguugugccgcgcuaugccggcgcccugaaccuuaauacaaaccuggcucccagcgucgccccuguguuccccggcgagagacuccuguuuuuccgguccuacaucccucuuaaagggggauauggcaaucccgcgauugacugccugcucccucaagagugggugcagcacuuuuaccaggaagcugcccccucuaucagcgagguugcccugguccgcuauauuaacccggauaccgggagagcucuguucgaagccaagcuccaccgggcuggauuuaugaccguguccagcaacacaucugccccuguggucgugcccgcgaauggcuacuucagauuugacuccuggguuaaccaguucuauagccuggccccuauggggaccggcaauggacgccggagagugcaauga

SEQ ID NO: 28337 - RNA, 1629 nt, Artificial Sequence
  derived and/or modified sequence opt5 from capsid_protein__Norovirus__BAG34654
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacaacuccccugggcauaaugagagcgccaaccggggacacgacgcugugguucccacauacacgucccaguacaccccgaaacugggccagauucaaaucgggacauggcagaccgaugaccugacagugaaucagccugucaaguucacccccgugggacucaacgauacggaacauuuuaaucaguggguugugccccgcuaugccggcgcccugaaccuuaauacaaaccuggcuccuucugucgccccgguguuccccggcgagagacuccuguuuuuccggagcuacaucccucuuaaagggggauauggcaaucccgcgauugacugccugcucccucaagagugggugcagcacuuuuaccaggaagcugcccccuccaugagcgagguugcccugguccgcuauaucaacccugauaccgggagagcucuguucgaagccaagcuccaccgggcuggauuuaugaccgugucuuccaacacaagcgcccccguggucgugccggcgaauggcuacuucagauuugacucuuggguuaaccaguucuauagccuggccccuauggggaccggcaauggacgccggagagugcaauga

SEQ ID NO: 28338 - RNA, 1629 nt, Artificial Sequence
  derived and/or modified sequence opt5 from capsid_protein__Norovirus__BAG34656
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacaacuccccugggcauaaugagcccgccaaccggggacacgacgcugugguuccgacauacacgagccaguacaccccuaaacugggccagauucaaaucgggacauggcagaccgaugaccugaucgugaaucagcccgucaaguucacacccgugggacucaacgauaccgaacauuuuaaucaguggguugugccucgcuaugccggcgcccugaaccuuaauacgaaccuggcuccguccgucgcccccguguucccuggcgagagacuccuguuuuuccggucuuacauuccccuuaaagggggauauggcaauccugcgaucgacugccugcucccccaagagugggugcagcacuuuuaccaggaagcugccccuagcauguccgagguugcccugguccgcuauauuaaccccgauacagggagagcucuguucgaagccaagcuccaccgggcuggauuuaugaccgugagcucuaacaccuccgccccgguggucgugccugcgaauggcuacuucagauuugacagcuggguuaaccaguucuauucucuggcccccauggggacaggcaauggacgccggagagugcaauga

SEQ ID NO: 28339 - RNA, 1629 nt, Artificial Sequence; identical to SEQ ID NO: 26868
  derived and/or modified sequence opt5 from capsid_protein__Norovirus__BAG34658

SEQ ID NO: 28340 - RNA, 1629 nt, Artificial Sequence
  derived and/or modified sequence opt5 from capsid_protein__Norovirus__BAG34662
augaagauggccagcaacgacgcugcccccuccaccgauggcgcggcugggcuggugccugagucuaauagcgaagucauggcccucgagccgguugccggagcugcccuggcugcccccgugacaggccagacgaacaucauugacccuuggaucagauccaauuucgugcaagcgcccaacggggaauuuaccgucucuccuagaaaugcccccggagaggugcuucugaaccucgaacugggcccugagcuuaauccguaccuggcucaccucgcccgcauguauaacggguacgcuggaggcauggagguucaggugaugcuggccggcaaugcguucacagccgggaaacuggucuuugcugccgugcccccucauuuccccguugaaaaccucagcccucagcagauuaccauguuuccccacgugaucauugaugucagaacacuggagccggugcuucugccucuccccgacgugcggaauaacuucuuucauuauaaucaaaaggaugacccuaaaaugcgcaucgucgcuaugcuguacacaccccuuagauccaacggaucuggcgaugacguuuucaccgugagcugccgggugcugacccgccccuccccugauuuugacuucacguaucucgucccgcccaccguggaaagcaagacaaaaccuuuuacccugcccauccugacacucggggagcugucuaauuccagauucccuguuagcauugaucagauguacaccucucccaacgaggugaucuccguccagugucagaacggacggugcacgcuugacggcgaacugcaagggacaacccagcuccaggugagcggaauuugugccuuuaagggcgagguuacagcccaucugcagaaugaugaccaccuuuauaacaucaccauuaccaaucugaacggcucuccguucgacccuuccgaagauauccccgcuccucucggggugcccgacuuccaaggacgcgucuuuggcgugauuacacagagagauaagcagaaugcgacggggcaaaaccagccugccaaucggggacacgacgcugucgugcccaccuacacagcccaguacaccccgaaacugggccagauccaaaucgggacauggcagaccgaugaccugaagguuaaccagccugugaaauucacgcccgucggacucaaugauacagagcacuuuaaccagugggugguuccccgcuaugccggcgcucugaaucuuaacaccaaucuggccccuagcguggcgccggucuuccccggcgaaagacuccuguuuuuccgguccuaccuuccucugaaagggggauauggcaaccccgcuauugacugccuccugccucaagagugggugcagcauuuuuaccaggaggccgcccccucuaugagcgaaguggcucugguucgcuauaucaauccugauaccgggagagcccucuucgaggcuaagcugcaccgggccggauuuaugacagucuccagcaacaccucugcgcccgugguggucccggccaacggcuacuucagauuugacuccugggugaaucaguucuauagccuugcuccuauggggacaggcaacggacgccggcggauucaauga

SEQ ID NO: 28341 - RNA, 1629 nt, Artificial Sequence
  derived and/or modified sequence opt5 from capsid_protein__Norovirus__BAG34664
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaauaucaccauuaccaaccugaauggcuccccguucgacccuagcgaagauacacccgcgccucucggggugcccgacuuccagggacgcgucuuuggcaucauuucucaaagagauaagcagaacgccacggggcacaaugagccugcuaaccggggacaugacgccgugguccccaccuacacagcccaguacaccccgaaacugggccaaauccagaucgggacauggcagaccgaugaccugacggugaaucagccuguuaaguucacacccgugggacucaacgauaccgaacacuuuaaucaaugggucgugccccgcuaugcuggcgcccugaaccuuaauaccaaccuggcgccuuccguugcuccgguguuccccggcgagagacuccuguuuuuccggagcuacauuccucuuaaagggggauauggcaaucccgccaucgacugccugcucccucaggaguggguccagcauuuuuaccaggaagccgcucccuccaugucugagguggcccuggugcgcuauauuaacccugauacagggagagcucuguucgaagccaagcuccaccgggcgggauuuaugaccguuagcuccaacacaagcgcccccgucguggugccggcuaauggcuacuucagauuugacucuugggucaaccaauucuauucccuggccccuauggggacgggcaauggacgccggagagugcaguga

SEQ ID NO: 28342 - RNA, 1629 nt, Artificial Sequence; identical to SEQ ID NO: 26868
  derived and/or modified sequence opt5 from capsid_protein__Norovirus__BAG34666

SEQ ID NO: 28343 - RNA, 1629 nt, Artificial Sequence
  derived and/or modified sequence opt5 from capsid_protein__Norovirus__BAG34668
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaauccuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacacgccccucuccugauuuugacuucaccuaucucgucccgcccacgguggaaagcaagaccaaaccuuuuacacugcccauucugacccucggggagcuguccaacagcagauucccuguuucuaucgaucagauguacacaucccccaacgaggugauuagcguccagugucagaauggacggugcacccuugacggcgaacugcaagggacgacacagcuccaggugucuggaaucugugccuuuaagggcgagguuaccgcucaucugcacgauaacgaccaccuuuauaaugugacaauuaccaaccugaauggcuccccguucgacccuagcgaagauauccccgcgccucucgggguccccgacuuccagggacgcguguuuggcgucauuucucaaagagauaagcacaacuccccugggcauaaugagcccgccaaccggggacacgacgcugugguuccgaccuacacaagccaguacacgccuaaacugggccagauccaaaucgggaccuggcagacagaugaccugaccgugaaucagcccgucaaguucacacccgugggacucaacgauaccgaacauuuuaaucaguggguugugccucgcuaugccggcgcccugaaccuuaauacgaaccuggcuccguccgucgcccccguguucccuggcgagagacuccuguuuuuccggucuuacauuccccuuaaagggggauauggcaauccugcgaucgacugccugcucccccaagagugggugcagcacuuuuaccaggaagcugccccuagcauguccgagguugcccugguccgcuauauuaaccccgauacagggagagcucuguucgaagccaagcuccaccgggcuggauuuaugaccgugagcucuaacaccuccgccccgguggucgugccugcgaauggcuacuucagauuugacagcuggguuaaccaguucuauucucuggcccccauggggacaggcaauggacgccggagagugcaauga

SEQ ID NO: 28344 - RNA, 1629 nt, Artificial Sequence
  derived and/or modified sequence opt5 from capsid_protein__Norovirus__BAG34670
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugucccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaaggguccacacagcuccaggugagcggaauuugugccuuuaagggcgagguuaccgcucaucugcacgauaaugaccaccuuuauaacgugacaaucaccaaucugaacggcucuccguucgacccuuccgaagauauucccgcgccucucgggguccccgacuuccagggacgcguguuuggcgucaucagccaaagagauaagcacaauuccccugggcauaacgagcccgccaaucggggacacgacgcugugguuccgaccuacacaucucaguacacgccuaaacugggccagauucaaaucgggaccuggcagacagaugaccugaccgugaaccagcccgccaaguucacacccgucggacucaaugauaccgaacauuuuaaccagugggugguuccucgcuaugccggcgcucugaaucuuaacacgaaucuggccccgagcguggcgcccgucuucccuggcgagagacuccuguuuuuccgguccuacaucccccuuaaagggggauauggcaacccugcuauugacugccugcucccccaagagugggugcagcacuuuuaccaggaagccgccccuagcaugucugagguggcucugguucgcuauaucaaucccgauacagggagagcccuguucgaagcuaagcuccaccgggccggauuuaugaccgucuccagcaacaccucugcgccggugguggucccugccaacggcuacuucagauuugacagcugggugaaucaguucuauucccuggcucccauggggacaggcaacggacgccggagaguucaauga

SEQ ID NO: 28345 - RNA, 1623 nt, Artificial Sequence
  derived and/or modified sequence opt5 from capsid_protein__Norovirus__BAG55289
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggagauacagcccaucggaaugagccccaacagugggugcucccuucuuacagcggccgcaacaaucacaacguucaccuggcgccggcuguggcccccacguuuccuggcgaacagcuucuguucuuuagauccaccaugcccggguguagcggauauccuaauauggaccucgauugccugcugccccaggaguggguccaauacuucuaucaggaagccgcuccugcccagucugacguggcucuccugcgguuugugaaccccgauacaggcagaguucuuuucgaguguaagcugcauaaauccggguacgucaccguggcccacacaggacagcaugaccucgugaucccgccuaacggcuauuuucgcuucgacagcugggucaaucaauucuacacccuggcgcccauggggaacggcacgggacggagacgcgcccuuuga

SEQ ID NO: 28346 - RNA, 1629 nt, Artificial Sequence
  derived and/or modified sequence opt5 from capsid_protein__Norovirus__BAG68707
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaauaucaccauuaccaaccugaauggcuccccguucgacccuagcgaagauauccccgcgccucucggggugcccgacuuccagggacgcgucuuuggcauuaucucucaaagagauaagcagaacgccacagggcacaaugagccugcuaaccggggacaugacguggucgugcccacguacaccgcccaguacacaccgaaacugggccaaauccagauugggaccuggcagacagaugaccugaccguuaaucagccugccaaguucacgcccgugggacucaacgauacagaacacuuuaaucaaugggucgugccccgcuaugcuggcgcccugaaccuuaauaccaaccuggcgccuuccguugcuccgguguuccccggcgagagacuccuguuuuuccggagcuacaucccucuuaaagggggauauggcaaucccgccauugacugccugcucccucaggaguggguccagcauuuuuaccaggaagccgcucccuccaugucugagguggcccuggugcgcuauaucaacccugauaccgggagagcucuguucgaagccaagcuccaccgggcgggauuuaugacaguuagcuccaacaccagcgcccccgucguggugccggcuaauggcuacuucagauuugacucuugggucaaccaauucuauucccuggccccuauggggacaggcaauggacgccggagagugcaguga

SEQ ID NO: 28347 - RNA, 1629 nt, Artificial Sequence
  derived and/or modified sequence opt5 from capsid_protein__Norovirus__BAG68708
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacucuaaaaugcgcaucgucgccaugcuguacaccccucuuagaagcaauggauccggcgaugacguuuucacagugucuugccgggugcugacccgccccagccccgauuuugacuucacguaucucgucccuccgaccguggaauccaagacaaaacccuuuacccugccuauccugacacucggggagcugagcaacucuagauuccccguuuccauugaucagauguacaccagcccuaacgaggugaucucuguccagugucagaauggacggugcacgcuugacggcgaacugcaagggacaacccagcuccagguguccggaauuugugccuuuaagggcgagguuacagcucaucugcacgauaacgaccaccuuuauaauaucaccauuaccaaccugaauggcagccccuucgacccgucugaagauaucccugcgccccucggggugccugacuuccagggacgcgucuuuggcauuaucucccaaagagauaagcagaacgccacagggcacagcgagcccgcuaaucggggacaugacgccguggucccuacguacaccgcccaguacacacccaaacugggccaaauccagauugggaccuggcagacagaugaccugaccgugaaccagccgguuaaguucacgccugugggacucaaugauacagaacacuuuaaccaaugggucgugccccgcuaugcuggcgcccugaaucuuaacaccaaucuggcgcccuccguugcuccuguguucccgggcgagagacuccuguuuuuccggucuuacaucccccuuaaagggggauauggcaacccugccauugacugccugcucccccaggaguggguccagcauuuuuaccaggaagccgcuccuagcauguccgagguggcccuggugcgcuauaucaaucccgauaccgggagagcucuguucgaagccaagcuccaccgggcgggauuuaugacaguuagcucuaacaccuccgccccugucguggcucccgccaacggcuacuucagauuugacagcugggugaaucaauucuauucucuggcuccgauggggacaggcaacggacgccggagaguccaguga

SEQ ID NO: 28348 - RNA, 1629 nt, Artificial Sequence
  derived and/or modified sequence opt5 from capsid_protein__Norovirus__BAG68709
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaauaucaccauuaccaaccugaauggcuccccguucgacccuagcgaagauauccccgcgccucucggggugcccgacuuccagggacgcgucuuuggcauuaucucucaaagagauaagcagaacgccacagggcacaaugagccugcuaaccggggacaugacgccgugguccccacguacaccgcccaguacacaccgaaacugggccaaauccagauugggaccuggcagacagaugaccugaccgugaaucagccuguuaaguucacgcccgugggacucaacgauacagaacacuuuaaucaaugggucgugccccgcuaugcuggcgcccugaaccuuaauaccaaccuggcgccuuccguugcuccgguguuccccggcgagagacuccuguuuuuccggagcuacaucccucuuaaagggggauauggcaaucccgccauugacugccugcucccucaggaguggguccagcauuuuuaccaggaagccgcucccuccaugucugagguggcccuggugcgcuauaucaacccugauaccgggagagcucuguucgaagccaagcuccaccgggcgggauuuaugacaguuagcuccaacaccagcgcccccgucguggugccggcuaauggcuacuucagauuugacucuugggucaaccaauucuauucccuggccccuauggggacaggcaauggacgccggagagugcaguga

SEQ ID NO: 28349 - RNA, 1629 nt, Artificial Sequence
  derived and/or modified sequence opt5 from capsid_protein__Norovirus__BAG68711
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacauugccuccgggcauaacgagccugcuaaucggggacacgacgccgugguucccacauacacggcccaguacaccccgaaacugggccagauccaaaucgggacauggcagaccgaugaccugacagugaaccagccugucaaguucacccccgugggacucaaugauacggaccauuuuaaccaguggguugugccccgcuaugcuggcgcccugaaucuuaacacaaaucuggcgccuagcgucgcuccgguguuccccggcgaaagacuccuguuuuuccgguccuacauuccucuuaaagggggauauggcaaccccgccaucgauugccugcucccucaagagugggugcagcacuuuuaccaggagucugcccccagcauguccgaaguugcucugguccgcuauauuaauccugacaccgggagagcccuguucgaggcuaagcuccaccgggccggauuuaugaccgugagcucuaacacauccgcgcccguggucgugccggccaacggcuacuucagauuugauagcuggguuaaucaguucuauucucuggcuccuauggggaccggcaacggacgccggagaacacaauga

SEQ ID NO: 28350 - RNA, 1629 nt, Artificial Sequence
  derived and/or modified sequence opt5 from capsid_protein__Norovirus__BAG68712
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacaacgccuccgggcauaaugagccugcuaaccggggacacgacgccgugguucccacauacacggcccaguacaccccgaaacugggccagauucaaaucgggacauggcagaccgaugaccugacagugaaucagccugucaaguucacccccgugggacucaacgauacggaacauuuuaaucaguggguugugccccgcuaugcuggcgcccugaaccuuaauacaaaccuggcgccuagcgucgcuccgguguuccccggcgagagacuccuguuuuuccgguccuacaucccucuuaaagggggauauggcaaucccgccauugacugccugcucccucaagagugggugcagcacuuuuaccaggaagccgcucccucuaugagcgagguugcccugguccgcuauaucaacccugauaccgggagagcucuguucgaagccaagcuccaccgggcgggauuuaugaccguguccagcaacacaucugcccccguggucgugccggcuaauggcuacuucagauuugacuccuggguuaaccaguucuauagccuggccccuauggggaccggcaauggacgccggagagugcaauga

SEQ ID NO: 28351 - RNA, 1629 nt, Artificial Sequence; identical to SEQ ID NO: 28350
  derived and/or modified sequence opt5 from capsid_protein__Norovirus__BAG68713

SEQ ID NO: 28352 - RNA, 1629 nt, Artificial Sequence
  derived and/or modified sequence opt5 from capsid_protein__Norovirus__BAG68714
augaagauggccagcaacgacgcugcccccuccaccgauggcgcggcugggcuggugccugagucuagcaaugaagucauggcccucgagccgguugccggagcugcccuggcugcccccgugacaggccagacgaacaucauugacccuuggaucagagcgaauuucgugcaagcccccaacggggaauuuaccgucuccccucggaaugcucccggagaggugcuucugaaccucgaacugggcccugagcuuaauccguaccuggcccaccucgcucgcauguauaacggguacgccggaggcauggagguucaggugaugcuggcgggcaaugccuucacagcugggaaacuggucuuugccgcugugcccccucauuuccccguugaaaaccucucuccucagcagauuaccauguuuccccacgugaucauugaugucagaacacuggagccggugcuucugccucuccccgacgugcggaauaacuucuuucauuauaaucaaaaggaugacccuaaaaugcgcaucgucgccaugcuguacacaccccuuagaagcaacggauccggcgaugacguuuucaccgugucuugccgggugcugacccgccccagcccugauuuugacuucacguaucucgucccgcccaccguggaauccaagacaaaaccuuuuacccugcccauccugacacucggggagcugagcaauucuagauucccuguuuccauugaucagauguacaccagccccaacgaggugaucucuguccagugucagaacggacggugcacgcuugacggcgaacugcaagggacaacccagcuccagguguccggaauuugugccuuuaagggcgagguuacagcucaucugcacgauaaugaccaccuuuauaacgugaccaucaccaaucugaacggcagcccguucgacccuucugaagauauucccgcgccucucgggguccccgacuuccagggacgcguguuuggcgucaucucccaaagagauaagcacaaugccagcgggcauaacgagccugcuaaucggggacacgacgccgugguucccacauacacggcccaguacaccccgaaacugggccaggugcaaauugggacauggcagaccgaugaccugacagucaaccagccugugaaguucacccccguuggacucaaugauacggaacauuuuaaccaguggguggucccccgcuaugcuggcgcccugaaucuuaacacaaaucuggcgccuuccguggcuccgguguuccccggcgagagacuccuguuuuuccggucuuacaucccucuuaaagggggauauggcaaccccgccaucgacugccugcucccucaagaguggguucagcacuuuuaccaggaagccgcucccagcauguccgaggucgcccuggugcgcuauauuaauccugauaccgggagagcucuguucgaagccaagcuccaccgggcgggauuuaugaccgugagcucuaacacauccgcccccgucgugguuccggcuaacggcuacuucagauuugacagcugggugaaucaguucuauucucuggccccuauggggaccggcaacggacgccggagaguccaauga

SEQ ID NO: 28353 - RNA, 1629 nt, Artificial Sequence
  derived and/or modified sequence opt5 from capsid_protein__Norovirus__BAG68715
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagagcgaacuucgugcaagcccccaauggggaauuuaccgucagcccucggaacgcucccggagaggugcuucugaaucucgaacugggcccugagcuuaacccguaccuggcccaccucgcucgcauguauaauggguacgccggaggcauggagguucaggugaugcuggcgggcaacgccuucacagcugggaaacuggucuuugccgcugugcccccucauuuccccguugaaaaucucuccccucagcagauuaccauguuuccccacgugaucauugaugucagaacacuggagccggugcuucugccucuccccgacgugcggaacaauuucuuucauuauaaccaaaaggaugacccuaaaaugcgcaucgucgccaugcuguacacaccccuuagaucuaauggaagcggcgaugacguuuucaccguguccugccgggugcugacccgccccucuccugauuuugacuucacguaucucgucccgcccaccguggaaagcaagacaaaaccuuuuacccugcccauccugacacucggggagcuguccaacagcagauucccuguuucuauugaucagauguacaccucccccaacgaggugaucagcguccagugucagaauggacggugcacgcuugacggcgaacugcaagggacaacccagcuccaggugucuggaauuugugccuuuaagggcgagguuacagcucaucugcacgauaacgaccaccuuuauaaugugaccaucaccaaccugaauggcuccccguucgacccuagcgaagauauucccgcgccucucgggguccccgacuuccagggacgcguguuuggcgucaucucucaaagagauaagcacaacuccccugggcauaaugagcccgccaaccggggacacgacgcugugguuccgacauacacggcccaguacaccccuaaacugggccagauucaaaucgggacauggcagaccgaugaccugacagugaaucagcccgucaaguucacccccgugggacucaacgauacggaacauuuuaaucaguggguugugccucgcuaugccggcgcucugaaccuuaauacaaaccuggccccgagcgucgcgcccguguucccuggcgagagacuccuguuuuuccgguccuacaucccccuuaaagggggauauggcaauccugcuauugacugccugcucccccaagagugggugcagcacuuuuaccaggaagccgccccuucuaugagcgagguugcucugguccgcuauaucaaccccgauaccgggagagcccuguucgaagcuaagcuccaccgggccggauuuaugaccguguccagcaacacaucugcgccgguggucgugccugccaauggcuacuucagauuugacuccuggguuaaccaguucuauagccuggcucccauggggaccggcaauggacgccggagagugcaauga

SEQ ID NO: 28354 - RNA, 1629 nt, Artificial Sequence; identical to SEQ ID NO: 26874
  derived and/or modified sequence opt5 from capsid_protein__Norovirus__BAG68716

SEQ ID NO: 28355 - RNA, 1647 nt, Artificial Sequence
  derived and/or modified sequence opt5 from capsid_protein__Norovirus__BAG68799
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgaugccaccacacgcgcgcaugaggcuaaaaucgacacggccagcgggagauuuaccccgaagcucggaucccuggaaauuagcacagagucugaugacuucgaucagaauaagccuacccgguuuacacccgugggcaucgggguugaccacgaagaggauuuccagcaauggacccugcccgacuacgccggacaguuuacgcacaacaugaaucucgcuccugccguggcuccgaacuuccccggcgagcagcugcuguuuuucagaucccagcuuccuagcucuggcgggcgcagcaauggaauccucgauugccuggucccccaagaaugggugcagcauuuuuaccaggaguccgccccuucucagagccaagucgcgcuugugcgguauauuaaccccgacacaggcagaguucuguucgaagccaaacuccacaagcugggguuuaugaccaucgcuaaaaacggagacuccccuauuaccgugcccccgaauggcuacuuccgcuucgagagcugggucaacccuuuuuauacacuggcccccauggggaccggcaauggacggagacgcauccaguga

SEQ ID NO: 28356 - RNA, 1647 nt, Artificial Sequence
  derived and/or modified sequence opt5 from capsid_protein__Norovirus__BAG68800
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauacauucuuucacuauaaccagggcucugacagccggcugcgccuuauugccaugcuguacacaccccucagagcuaacaauuccggggaugacgucuucaccgugucuugucgggugcugacccgcccuagccccgauuuuuccuucaacuuucuuguucccccuacagucgagagcaagaccaaaccguucucucugcccauccucacgauuuccgaaaugagcaauucuagauuuccugugcccaucgacucccugcauaccagcccuacagagaacaucgugguccagugccagaauggacgggugacccuggauggcgagcucauggggacaacccaacugcuucccucucagauuugugcguuccgcggaguucugacgagauccacaagccgggccuccgaccaggcugauaccgccacaccgcgccucuucgacuauuacuggcacauccagcuggacaaccuuaauggcaccccuuaugaucccgccgaagacauuccuggcccccuggggaccccugauuuuagaggaaagguguucggcgucgcuucucaacggaaccccgacacaacgacccgcgcccaugaggcgaaaaucgauacagcuagcgggagauuuaccccgaagcucggaucccuggaaauuagcacagagucugacgauuucgaccagaauaagccuacccgguuuacgcccgugggcaucgggguugaucacgaagaggacuuccagcaauggacacugcccaacuacgccggacaguuuacccacaauaugaaccucgccccugcuguggccccgaauuuccccggcgagcagguccuguuuuucagaucccagcuuccuagcucuggcgggcgcagcaacggaauccuggauugccucgugccccaagaauggguccagcauuuuuaccaggaguccgcuccuucucagagccaaguggcccugguucgguaugugaaucccgacaccggcagaguccuuuucgaagcgaaacugcacaagcucggguuuaugacaauugcccgcaacggagacuccccuaucaccgugcccccgaacggcuacuuccgguucgagagcuggguuaauccuuuuuauacacuggcucccauggggacgggcaacggaagacgccggauucaguga

SEQ ID NO: 28357 - RNA, 1623 nt, Artificial Sequence; identical to SEQ ID NO: 26948
  derived and/or modified sequence opt5 from capsid_protein__Norovirus__BAG68801

SEQ ID NO: 28358 - RNA, 1623 nt, Artificial Sequence
  derived and/or modified sequence opt5 from capsid_protein__Norovirus__BAG68802
augaagauggccagcaacgacgcuacccccuccgauggcucuacagccaaucuggugccugaggucaacaaugaaguuauggcgcucgagccgguggcuggggccgccaucgcugcccccguggcuggacagcaaaacgucauugacccuuggaucagaaauaacuucgugcaggcccccggcggggaauuuacgguuagcccucggaaugcgcccggagagauucugugguccgccccucuuggcccggaucugaaccccuaccucucucaccuggcucgcauguauaauggguacgccggaggcuucgaagugcaggucauccuugcuggcaacgccuuuaccgcggggaaaauuaucuucgccgcugugccucccaauuuuccuacagagggacugagccccucccagguuaccauguucccgcauaucauuguggacgucagacaacucgagccugugcugaucccccugccugaugugcggaacaauuuuuaucacuacaaccagucuaaugaccccacaauuaagcucaucgccaugcuguauacaccccuucgcgcuaacaacgccggcgaugacgucuucaccguuagcugcagagugcugacccggccuuccccggauuuugacuucauuuuucucgugcccccuacggucgaaagccgcaccaaacccuucucugugccuauccugacaguugaggaaaugaccaauuccagauuucccauuccgcuugagaagcuguucacagggccuagcucugccuucgugguccagccccagaacggacgguguaccacggauggcgugcuccuggggacaacccaacuguccccuguuaauaucugcacauuucgcggagacgugacccauaucgcuaacacccagaauuacacaaugaaccucgcgagccagaauuggaacaauuaugaucccacggaggaaauuccugcuccccugggcaccccggacuucgucggcagaauccagggggugcuuacacaaaccacacggggagacggcucuacccgcgggcacaaagccacggucuccacaggaagcgugcauuuuaccccuaagcugggcuccguucaguucucuaccgauacaagcaacgaccucgagaccgggcagaauacaagauuuacgcccgugggagucgugcaagauggcggcaccacacaccggaacgaaccccagcaguggguucugccugacuacuccgggcgcgauagccacaaugugcaucuugccccggccgucgcucccaccuucccuggagagcagcugcucuuuuucagaucuacaaugcccggcuguuccggguacccuaacaugaaucuggacugccugcucccccaagaaugggugcagcacuuuuaucaggagagcgccccugcgcagucugauguggcucugcuucgguucguuaaccccgacaccggaagaguccuguuugaguguaagcuccauaaaagcggcuacgugacgguggcccacaccgggcaacacgaucuggucauuccgccuaacggcuauuuccgcuuugacuccugggugaaucaguucuacacacuugcccccaugggaaacggcgcugggcggagacgcgcccuguga

SEQ ID NO: 28359 - RNA, 1623 nt, Artificial Sequence
  derived and/or modified sequence opt5 from capsid_protein__Norovirus__BAG68803
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaaggaagacgggucuacccggggacacaaggcuacaguguacaccggcuccgccccguuuacgccuaaacucgggagcguucaguucuccacagacaccgagaacgauuuugaaacccaucaaaauacaaaguucacccccgugggagucauucaggacggcucuacaacgcaccgcaacgagccccagcaaugggugcugccuagcuacuccggcagaaauguucacaacgugcaucuugccccggcugucgcccccaccuuuccuggggagcagcuccuguucuuucggagcacaaugcccggauguucuggcuauccuaauauggaucuggacugccugcucccccaggaaugggugcagcacuucuaccaagaggcggcuccugcccaguccgauguggcccugcuucgcuuuguuaaccccgacaccgggagaguccuguucgaauguaaacuccauaagagcggauaugugacaguggcucacaccggccagcacgaucuggucaucccgccuaacggguacuuucgguucgacucuugggugaaucaguucuauacgcuugcccccaugggcaacggaaccggcagacgccgggcucuguga

SEQ ID NO: 28360 - RNA, 1623 nt, Artificial Sequence; identical to SEQ ID NO: 26932
  derived and/or modified sequence opt5 from capsid_protein__Norovirus__BAG68804

SEQ ID NO: 28361 - RNA, 1623 nt, Artificial Sequence
  derived and/or modified sequence opt5 from capsid_protein__Norovirus__BAG68805
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuguuuucgcggccgugccucccaauuuuccuaccgaggggcugucucccagccaggucacaauguucccgcauaucaucguggacgugagacaacucgagccuguccugauuccccugccugauguucggaacaauuuuuaucacuacaaccaguccaaugaccccaccaucaagcucauugcuaugcuguauacaccccuucgcgccaacaacgcuggagaugacguguucaccgugagcugcagaguccugacacggccuucuccggauuuugacuucaucuuucucgugcccccuaccguugaaucccgcacgaaacccuucagcgugccuauucugaccgucgaggaaaugacaaauucuagauuucccaucccgcuugagcggcuguucaccggcccuuccagcgccuucgugguucagccccagaacgggcgcuguacaaccgauggagugcuccugggcacgacacaacugucuccugucaauauuugcaccuuuagaggggacgugacacauaucgccggaacccaggaguacaccaugaaccucgcuucccagaauuggaacaauuaugaucccacagaagaggucccugcgccccugggcacgccggacuucaugggcaagauccagggggugcuuacccaaacaacccggcgcgacggaagcacaagaggccacaaagccaccguuuccacggggucugugcauuuuacaccuaagcugggacggauucaguucagcaccgauaccuccaacgacuuugaaacaggccagaauacccgcuucacacccgucggggugguucaagauggaagcacgacccaccagaacgagccccagcagugggugcucccuaauuacucuggcagagacucccacaacguccaucuggcuccggccguggcccccagcuuuccuggcgaacaacuucuguucuuucggucuacaaugcccggguguagcggauacccuaauaugaaccucgauugccugcugccccaggagugggugcagcacuucuaucaggaggcugccccugcgcaauccgacguugcucuccugagauuugucucucccgauaccggccgcgugcuuuucgaauguaagcugcauaaaagcggguacgugacagucgcccacaccggacagcacgaccucgugaucccgccuaauggcuauuuucgguucgauuccuggguuaaccaguucuacacgcuggcccccauggggaacggcaccggaagacgccgggcucuuuga

SEQ ID NO: 28362 - RNA, 1623 nt, Artificial Sequence
  derived and/or modified sequence opt5 from capsid_protein__Norovirus__BAG68806
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugacuccaccaucaagcucauugcuaugcuguauacaccccuucgcgccaacaacgcuggcgaugacguguucaccgugagcugcagaguccugacacggcccucuccugauuuugacuucaucuuucucgugccgcccaccguugaaucccgcacgaaaccuuucagcgugcccauucugaccgucgaggaaaugacaaauucuagauuuccuaucccccuugagaagcuguucaccgggccguccagcgccuucauugugcagccucagaacggacgguguacaaccgauggcguucuccuggggacgacacaacugucucccgugaauaucugcaccuuucgcggagacgucacacauaucgccggcacccaggaguacaccaugaaccucgcuucccagaauuggaacaauuaugauccuacagaagagauucccgcgccucugggcacgcccgacuucguggggaaaauccagggaguccuuacccaaacaaccagacgggacggcagcacacgcgggcacaaggccaccguguccacgggaucuguucauuuuacaccgaagcugggcagaauccaguucagcaccgauaccuccaacgacuuugaaacagggcagaauacccgguucacaccugugggagucgugcaagauggcagcacgacccaccagaacgagccccagcaguggguucuccccaauuaccugggccgcgacucucacaacgugcaucuugcuccugccgucgccccguccuuucccggggaacaacuccuguucuuuagaagcacaaugccuggauguucuggcuaccccaauaugaaccuggauugccugcucccucaggagugggugcagcacuucuaucaggaggcugcccccgcgcaaagcgacguggcucugcuucgguuuguuaauccugauaccgggagaguccuguucgaauguaaacuccauaaguccggauacgugacaguggcccacaccggccagcacgaccuggucauucccccgaacggguauuuucgcuucgauucuugggugaaccaguucuacacgcuugccccuaugggcaauggaaccggccggagacgcgcucuguga

SEQ ID NO: 28363 - RNA, 1647 nt, Artificial Sequence
  derived and/or modified sequence opt5 from capsid_protein__Norovirus__BAG68807
augaagauggccagcuccgacgcuacccccucuaacgauggcgccgcggggcuggugccugagaucaauaacgaagcuauggcccucgacccggucgccggagcugccauugcugcgccccugacaggccagcaaaauaucauugauccuuggaucaugaacaauuucguucaggcccccgggggagaguuuacggugagcccuagaaacucccccggcgaagugcuucugaaucucgagcuggggccugaaauuaacccguaccuugcccaccuggcucggauguauaauggauacgccggcggcuucgagguccaggugguucucgcugggaacgccuuuaccgcgggaaaaaucaucuucgccgcuauucccccuaauuuucccaucgacaaccugucugccgcucagauuacaaugugcccucaugugaucgucgaugugcgccaacuggagcccguuaaucucccgaugccugacgugagaaacaauuucuuucacuauaaccagggcagcgauucccggcugcgccuuauugccaugcuguacacaccccucagagccaacaauucuggggacgaugucuucaccgugagcugucgggugcugacccgcccuucccccgacuuuagcuucaacuuucuuguucccccuacagucgaaucuaagaccaaaccguucacgcugcccauccucaccauuuccgagaugagcaauucuagauuuccugugcccaucgauucccugcauacaagcccuaccgaaaacaucgugguccagugccagaauggacgggugacacuggacggcgagcucauggggaccacgcaacugcuucccucucagauuugugcuuuccgcggaguucugacaagauccaccagccgggcguccgaucaggccgacacagcuaccccgcgccucuucaacuauuacuggcacauccagcuggacaaucuuaacggcaccccuuaugaucccgccgaggacauuccuggcccccuggggacaccugauuuuagaggaaagguguucggcgucgccucucaacggaaucccgacagcacgacccgcgcucaugaagccaaaguggauacaaccgcggggagauuuacaccgaagcucggaucccuggagaucagcaccgaaucugacgauuucgaccagaaccagccuacgcgguuuacacccguuggcauugggguggaucacgaggcugacuuccaacaguggucccugcccgauuacagcggacaguuuacccacaauaugaaccucgccccugccgucgcuccgaauuuccccggcgaacagcugcuguuuuucagaucucaacuuccuagcuccggcgggcgcucuaacggaauccucgacugccuggugccccaggaguggguccagcauuuuuaccaggagagcgccccugcucaaacccagguggcccuuguucgguaugugaaucccgacacaggcagaguccuguucgaagcgaagcuccacaaacugggguuuaugaccaucgccaagaacggagauuccccuauuacagugcccccgaacggcuacuuccgcuucgagagcuggguuaauccuuuuuauacgcuggcucccauggggaccggcaacggacggagacgcauccaguga

SEQ ID NO: 28364 - RNA, 1623 nt, Artificial Sequence
  derived and/or modified sequence opt5 from capsid_protein__Norovirus__BAG68808
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgauagcugcagagugcugacccggccuuccccggacuuugauuucauuuuucucgugcccccuacggucgaaagccgcaccaaacccuucucugugccuauccugacaguugaggaaaugaccaauuccagauuucccauuccgcuugagaagcuguucacagggccuagcucugccuucgugguccagccccagaacggacgguguaccacggacggcgugcuccuggggacaacccaacuguccccuguuaauaucugcacauuucgcggagaugugacccauaucgccggcacccagaacuacacaaugaaucucgcuagccagaacuggaauaacuaugaccccacggaggaaauuccugcgccccugggcaccccggacuucgucgggaaaauccagggagugcuuacacaaaccacaagacgggauggcucuacccgcgggcacaaggccacggucuccacaggaagcgugcauuuuaccccuaagcugggcuccguucaguucucuaccgacacaagcaaugaucucgagaccgggcagaacacaagauuuacgcccgugggagucgugcaagacggcuccaccacacaccagaaugaaccccagcaguggguucugccugauuacagcggccgggacucucacaacgugcaucuugcuccggccgucgcccccaccuucccuggggagcaacugcucuuuuuccgcuccacaaugcccggauguagcggcuacccuaauaugaaccuggauugccugcucccccaggaaugggugcagcacuuuuaucaggagucugcuccugcccaaagcgacguggcgcugcuuagauucguuaaucccgauaccgggcggguccuguuugaguguaaacuccauaaguccggauacgugacgguggcucacaccggccagcacgaccuggucauuccgccuaacggguauuucagauuugauucuugggugaaccaguucuacacacuugcccccaugggcaauggagccggccgccggagagcucuguga

SEQ ID NO: 28365 - RNA, 1623 nt, Artificial Sequence
  derived and/or modified sequence opt5 from capsid_protein__Norovirus__BAG68809
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgauagcugcagagugcugacccggccuuccccggacuuugauuucauuuuucucgugcccccuacggucgaaagccgcaccaaacccuucucugugccuauccugacaguugaggaaaugaccaauuccagauuucccauuccgcuugagaagcuguucacagggccuagcucugccuucgugguccagccccagaacggacgguguaccacggacggcgugcuccuggggacaacccaacuguccccuguuaauaucugcacauuucgcggagaugugacccauaucgccggcacccagaacuacacaaugaaucucgcuagccagaacuggaauaacuaugaccccacggaggaaauuccugcgccccugggcaccccggacuucgucgggaaaauccagggagugcuuacacaaaccacaagaggcgaugggucuacccggggacacaaggccacggucuccacaggcagcgugcauuuuaccccuaagcugggguccguucaguucucuaccgacacaagcaaugaucucgagaccggacagaacacacgcuuuacgcccgugggcgucgugcaagacggcuccaccacacaccagaaugaaccccagcaguggguucugccuaacuacagcgggagagauucucacaaugugcaucuugcuccggccgucgcccccaccuucccuggagagcaacugcucuuuuuccgguccacaaugcccggcuguagcggguacccuaacaugaaucuggacugccugcucccccaggaaugggugcagcacuuuuaucaggagucugcuccugcccaaagcgauguggcgcugcuucgcuucguuaaccccgacaccggaagaguccuguuugaguguaaacuccauaaguccggcuacgugacgguggcucacaccgggcagcacgaucuggucauuccgccuaacggcuauuuccgguuugacucuugggugaaucaguucuacacacuugcccccaugggaaacggcgccgggagacgccgggcucuguga

SEQ ID NO: 28366 - RNA, 1623 nt, Artificial Sequence
  derived and/or modified sequence opt5 from capsid_protein__Norovirus__BAG68810
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccggaacccaggaguacaccaugaaccucgcuucccagaauuggaacaauuaugaucccacagaagagauuccugcgccccugggcacgccggacuucgugggcaaaauccaggggguccuuacccaaacaaccagacgggacggaagcacacgcggccacaaggccaccguguccacggggucuguucauuuuacaccuaagcugggacggauucaguucagcaccgauaccuccaacgacuuugaaacaggccagaauaccagauucacacccgugggggucgugcaagauggaagcacgacccaccagaacgagccccagcaguggguucucccuaauuacucuggccgcgacggccacaacgugcaucuggcuccggccgucgcccccuccuuuccuggggaacaacuucuguucuuuagaagcacaaugcccggauguucuggcuacccuaauaugaaccucgauugccugcugccccaggagugggugcagcacuucuaucaggaggcugccccugcgcaaagcgacguggcucuccugcgguuuguuaaucccgauaccgggagaguccuuuucgaauguaaacugcauaaguccggauacgugacaguggcccacaccggccagcacgaccucgucaucccgccuaacggguauuuucgcuucgauucuugggugaaccaguucuacacgcuggcccccaugggcaauggaaccggccggagacgcgcucuuuga

SEQ ID NO: 28367 - RNA, 1623 nt, Artificial Sequence
  derived and/or modified sequence opt5 from capsid_protein__Norovirus__BAG68811
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuucgcgccaacaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccggcccuuccagcgccuucgucgugcagccccagaacgggcgguguacaaccgauggaguucuccugggcacgacacaacugucuccugugaauaucugcaccuuucgcggggacgucacacauaucgccaacacccaggaguacaccaugaaucucgcuucccagaacuggaauaacuaugaucccacagaagagauuccugcgccccugggaacgccggacuucgugggcaaaauccagggcguccuuacccaaacaaccagacgggacgggagcacacgcggacacaaggccaccguguccacgggcucuguucauuuuacaccuaagcuggggcggauucaguucagcaccgauaccuccaaugacuuugaaacaggacagaacaccagauucacacccgugggcgucgugcaagaugggagcacgacccaccagaaugagccccagcaguggguucucccuaacuacucuggaggcgacggccacaaugugcaucuggcuccggccgucgcccccuccuuuccuggggaacaacuucuguucuuucgcagcacaaugcccggauguucuggcuacccuaacaugaaucucgauugccugcugccccaggagugggugcagcacuucuaucaggaggcugccccugcgcaaagcgacguggcucuccugagauuuguuaaccccgauaccgggcggguccuuuucgaauguaaacugcauaaguccggauacgugacaguggcccacaccggccagcacgaccucgucaucccgccuaacggguauuuuagauucgauucuugggugaaucaguucuacacgcuggcccccaugggcaacggaaccggccgccggagagcucuuuga

SEQ ID NO: 28368 - RNA, 1623 nt, Artificial Sequence; identical to SEQ ID NO: 27495
  derived and/or modified sequence opt5 from capsid_protein__Norovirus__BAG68812

SEQ ID NO: 28369 - RNA, 1623 nt, Artificial Sequence
  derived and/or modified sequence opt5 from capsid_protein__Norovirus__BAG68813
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccugucccgcauguauaauucuuacgccgggggauucgaaguccaggugauccuugcuggcaacgccuuuacggcuggcaaaauuaucuucgccgcgguuccucccaauuuuccuaucgaggggcugagccccucccaggugaccauguucccgcauauuaucgucgacgugagacaacucgagccugugcugauuccccugccugauguccggaacaauuuuuaucacuacaaccagagcaaugaccccacaaucaagcucauugccaugcuguauacaccccuucgcgcuaacaacgccggagaugacguuuucaccgugucuugcagagugcugacccggccuuccccggauuuugacuucaucuuucucgugcccccuacagucgaaagccgcaccaaacccuucucuguuccuauucugacgguggaggaaaugaccaauuccagauuucccacaccggucgagaaacuuuucaccggcccuagcucugcuuucaucgugcagccccagaacgggcgguguacaaucgauggaguucugcucggcaccacgcaacuguccccugugaauauuugcacauuucgcggggacgucacccauaucgccggaacacaggaguacaccaugaaccuggccagccagaauuggaacaauuaugaucccaccgaagagauuccugcuccccucggcacaccggacuucgugggcaagauccaggggguccugacgcaaaccacaagacgggacggauccacccgcggccacaaggcgacagugucuaccgggagcguucauuuuacgccuaaacuuggacggauucaguucuccacagauaccagcaacgacuuugaaaccagacagaauacacgcuucacccccgugggcgucauccaagaugggucuacaacgcaccagaacgagccccagcagugggugcugccuaauuacuccggaagagacagccacaacguucaucucgccccggcuguggcccccucuuuuccuggcgaacaacugcuuuucuuucggagcaccaugcccggcuguuccggguacccuaauaugaaccuggauugccuccugccccaggaguggguccagcacuucuaucaggaggccgcuccugcccaaucugacguggcgcugcucagauuugugaaucccgauacaggacgcguuauguucgaauguaagcugcauaagagcggcuacaucaccgucgcucacacagggcagcacgaccuugugauuccgccuaacggauauuuucgguucgaugccugggugaaccaguucuacacccuggcccccaugggcaaugggacgggcagacgccgggcucucuga

SEQ ID NO: 28370 - RNA, 1647 nt, Artificial Sequence
  derived and/or modified sequence opt5 from capsid_protein__Norovirus__BAG68814
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgauaccacaacgcgcgcccaugaggcgaaaaucgacaccacaagcgggagauuuaccccgaagcucggaucccuggaaauuagcacagagucugaugacuucgaucagaauaagccuacccgguuuacgcccgugggcaucgggguugacagagaaguggauuuccagcaaugggcucugcccgacuacgccggacaguuuacacacaacaugaaucucgccccugcugucgccccgaacuuccccggcgagcagcugcuguuuuuccgcucccagcuuccuagcucuggcgggcggagcaauggaauccucgauugccuggugccccaagaguggguccagcacuuuuaccaggaauccgcuccuucucagagccaaguggcccuuguuagauauauuaaccccgacaccggccgcgugcuguucgaggcgaaacuccauaagcugggguuuaugaccaucgccaaaaacggagacuccccuauuacagugcccccgaauggcuacuuccgguucgaaagcugggucaacccuuuuuauacccuggcucccauggggacaggcaauggaagacgccggauccaguga

SEQ ID NO: 28371 - RNA, 1647 nt, Artificial Sequence
  derived and/or modified sequence opt5 from capsid_protein__Norovirus__BAG68815
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgauaccacaacgcgcgcccaugaggcgaaaaucgacaccacaagcgggagauuuaccccgaagcucggaucccuggaaauuagcacagagucugaugacuucgaucagaauaagccuacccgguuuacgcccgugggcaucgggguugaccacgaaguggauuuccagcaaugggcucugcccgacuacgccggacaguuuacacacaacaugaaucucgccccugcugucgccccgaacuuccccggcgagcagcugcuguuuuucagaucccagcuuccuagcucuggcgggcgcagcaauggaauccucgauugccuggugccccaagaguggguccagcauuuuuaccaggaauccgcuccuucucagagccaaguggcccuuguucgguauauuaaccccgacaccggcagagugcuguucgaggcgaaacuccacaagcugggguuuaugaccaucgccaaaaacggagacuccccuauuacagugcccccgaauggcuacuuccgcuucgaaagcugggucaacccuuuuuauacccuggcucccauggggacaggcaauggacggagacgcauccaguga

SEQ ID NO: 28372 - RNA, 1623 nt, Artificial Sequence
  derived and/or modified sequence opt5 from capsid_protein__Norovirus__BAG68816
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaugaucgucgacgugagacaacucgagccugugcugauuccccugccugauguccggaacaauuuuuaucacuacaaccagagcaaugaccccaccaucaagcucauugcuaugcuguauacaccccuucgcgccaacaacgcuggcgaugacguuuucaccguguccugcagagugcugacacggccuagcccggauuuugacuucaucuuucucgugcccccuaccgucgaaucucgcacgaaacccuucuccguuccuauucugaccguggaggaaaugacaaauagcagauuucccaucccgcuugagaagcuguucaccgggccuucuuccgccuucgucgugcagccccagaacggacgguguacaaccgauggcguucuccuggggacgacacaacugagcccugugaauauuugcaccuuucgcggagacgucacacauaucgccggcacccaggaguacaccaugaaccucgcuucucagaauuggaacaauuaugaucccacagaagagaucccugcgccccugggcacgccggacuucguggggaaaauucagggaguccuuacccaaacaaccagaggcgacggguccacacggggacacaaggccaccgugagcacgggcuccguucauuuuacaccuaagcuggggcgcauccaguucucuaccgauaccagcaacgacuuugaaacaggacagaauaccagauucacacccgugggcgucgugcaagauggcuccacgacccaccagaacgagccccagcaguggguucucccuaauuacagcgggcgggacucucacaacgugcaucuggcuccggccgucgcccccuccuuuccuggagaacaacuucuguucuuucgcagcacaaugcccggcuguucuggguacccuaauaugaaccucgauugccugcugccccaggagugggugcagcacuucuaucaggaggcugccccugcgcaaagcgacguggcucuccugagauuuguuaaucccgauaccggacggguccuuuucgaauguaaacugcauaaguccggcuacgugacaguggcccacaccgggcagcacgaccucgucauuccgccuaacggcuauuuuagauucgauucuugggugaaccaguucuacacgcuggcccccaugggaaauggcaccgggcgccggagagcucuuuga

SEQ ID NO: 28373 - RNA, 1626 nt, Artificial Sequence
  derived and/or modified sequence opt5 from capsid_protein__Norovirus__BAH04374
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccauuuacggccuccugguugacccuucucuucccuccaauccgcaauggcagaacgggagagugcacgucgauggaacacugcucggcaccacgccugugagcggcucuuggguuuccuguuucgccgcugaagccgccuaugaguuucagagcgggacaggagagguggcuaccuucacacugaucgaacaagacggcucugccuacguccccggggaucgggcggcuccucugggauaccccgacuuuuccggccagcucgagauugaagugcagaccgagaccacaaagaaaggggaaaagcugaaggucacgaccuucgagaugauccuuggaccuacaaccaauguggaccagguucccuaucaaggccgcguguacgccagccugacagccgcugccucccucgaucuggucgacggcagagugcgggcuguuccgcgcucuguguauggguuccaggaugucgugccugaguacaacgacggacuucuggugccccucgcgcccccuauuggcccguuucugcccggggaaguucugcucagauuccggaccuauaugagacagaucgauagcacggacgccgccgcugaggccaucgauugcgcucugccucaggaauuugucuccugguucgccagcaaugcguuuacagugcaaucugaggcccuucugcuccgcuaccggaacacccugaccggacagcugcuuuucgaauguaaacucuauuccgagggcuacauugcucugagcuacucugggagcggcccccugacauuuccuaccgacggauucuuugagguggucuccugggugcccagacucuaucagcuggccucuguuggcagccuugcuacagggcgcacgcugaagcaguga

SEQ ID NO: 28374 - RNA, 1626 nt, Artificial Sequence
  derived and/or modified sequence opt5 from capsid_protein__Norovirus__BAH04377
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccauuuacggccuccugguugacccuucucuucccuccaauccgcaauggcagaacgggagagugcacgucgauggaacacugcucggcaccacgccugugagcggcucuuggguuuccuguuucgccgcugaagccgccuaugaguuucagagcgggaucggagagguggcuacauucacccugauugaacaagacggcucugccuacguccccggggaucgggcggcuccucugggauaccccgacuuuuccggccagcucgagaucgaagugcagacagagaccaccaagaaaggggaaaagcugaaggucacaacguucgagaugauucuuggaccuaccacaaauguggaccagguucccuaucaaggccgcguguacgccagccugaccgccgcugccucccucgaucuggucgacggcagagugcgggcuguuccgcgcucuguguauggguuccaggaugucgugccugaguacaacgacggacuucuggugccccucgcgcccccuaucggcccguuucugcccggggaaguucugcucagauuccggacauauaugagacagaucgauagcaccgacgccgccgcugaggccauugauugcgcucugccucaggaauuugucuccugguucgccagcaaugcguuuacggugcaaucugaggcccuucugcuccgcuaccggaacacacugaccggacagcugcuuuucgaauguaaacucuauuccgagggcuacaucgcucugagcuacucugggagcggcccccugaccuuuccuacagacggauucuuugagguggucuccugggugcccagacucuaucagcuggccucuguuggcagccuugcuaccgggcgcacacugaagcaguga

SEQ ID NO: 28375 - RNA, 1623 nt, Artificial Sequence; identical to SEQ ID NO: 27635
  derived and/or modified sequence opt5 from capsid_protein__Norovirus__BAH29786

SEQ ID NO: 28376 - RNA, 1623 nt, Artificial Sequence
  derived and/or modified sequence opt5 from capsid_protein__Norovirus__BAH30707
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucagcggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuugccccuaagcugggcagaguucaauucgccaccgacaccgauaaugacuuugaugcuaaucagaacacaaaauucacccccgugggggucauucaggacggaaauacagcccaucggaacgagccccaacagugggugcucccuucuuacagcggccgcaauucccacaacguucaccuggcgccggcuguggcccccacguuuccuggcgaacagcuucuguucuuuagaagcaccaugcccggguguucuggauauccuaauauggaucucgacugccugcugccccaggaguggguccaauacuucuaucaggaagccgcuccugcccaguccgauguggcucuccugcgguuugugaaccccgacacaggcagaguucuuuucgaguguaagcugcauaaaagcggguacgucaccguggcccacacaggacagcaugaucucgugaucccgccuaacggcuauuuucgcuucgacucuugggucaaucaauucuacacccuggcgcccauggggaacggcacgggacggagacgcgcccuuuga

SEQ ID NO: 28377 - RNA, 1653 nt, Artificial Sequence
  derived and/or modified sequence opt5 from capsid_protein__Norovirus__BAL40869
augaagauggccagcaacgacgcugcccccuccaaugauggcgcggcuaaccuggugccugaagccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcagguccaagucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccgccaucgacaugcucuauacagauccuaaugaguccauugugguccaaccccagaacggcagaugcacccuggacgggacacuucagggaaccacgcagcuggugccgacacaaaucugugcuuuucggggcacccucauuagccagacagcgcgcgccguugauucuaccgacuccccucagagagcucgggaucacccccugcaugugcaagucaagaaucuugacgggacccaguacgacccuacagaugacauccccgccgugcugggagccaucgauuucaaaggcacggucuucggcguggcuagccagcgcgacguuucugggacccaggaacaaggacacuaugccacaagagcgcacgaggcucauauugauaccacagacccuaaguacgcccccaagcucggcaccauccugauuaaauccgaaagcccggauuuuaacacgaaucagccuauccgguucacacccguggggaugggagacaacaauuggagacagugggagcugcccgauuacuccggccgccucacccugaacaugaaucuugccccugcugucucuccgagcuuucccggggagcggauucuguucuuuagauccaucgugccuagcgccggaggcuauggcucuggguacaucgacugccucauuccccaggaauggguucaacacuucuaucaggaggcugccccuucccagagcgcgguggcccugguccgcuacgugaaccccgauaccggacggaauaucuuugaagcuaaacuucauagagagggcuuccugacaguggccaacucugggaauaacccuauuguugugcccccgaauggauauuuucgcuucgaggcuugggugaaccaguuuuacacccucgccccuaugggcagcgggcaaggccggagacgcgcgcaguga

SEQ ID NO: 28378 - RNA, 1644 nt, Artificial Sequence
  derived and/or modified sequence opt5 from capsid_protein__Norovirus__BAL40870
augaagauggccagcuccgacgcugcccccucuaacgauggcgcggcuaaucuggugccugaggccaacaaugaagucauggcccucgagccgguugugggggcuagcaucgccgcucccguggucggacagcaaaacauuaucgacccuuggauuagagaaaauuucgugcaggcgccccagggcgaguuuaccguuuccccucggaacucucccggggaaaugcugcuuaaucuggagcucggaccugagcugaacccguaccuuagccaccugucccgcauguauaauggcuacgccgggggaaugcaagugcaggucgugcucgccggcaacgcuuucacagccggcaaaaucauuuuugcugccguucccccucauuuccccguggaaaauaucucugcggcccagaucacgaugugcccucacgucauuguggaugugagacagcuggagcccguccugcucccgcugccugacauccggaaccgcuuuuuccauuauaaucaggaaaacacccccagaaugcggcuuguugcuaugcuguacacaccucuccgcgccaauagcggggaggauguguuuaccguguccuguagaguccugacacggcccgcucccgacuucgaguuuaccuuccuugugccuccgacaguugaaagcaagaccaaacccuuuacgcugccuauucucacccugggagagcugucuaacucccgcuuccccgccccuaucgauaugcucuauacagaccccaacgaaggcauugugguccaaccgcagaaugggagaugcacccuggauggaacacuucagggcaccacgcagcuggugccuacacaaaucugugccuuucgggggacccucauuggacagacaagcagaucuuccgacagcaccgauucugcuccccgccggcgcgaccacccucugcauguucagcuuaagaaccuggauggcacccaauacgaccccacagacgaggugccugcgguccucggcgccaucgauuucaaagggacgguguucggagucgcuucccagagagacgugagcggccagcagguuggggccacccgggcccacgaagugcacaucaauacaaccgaucccagauauacaccgaagcugggauccauucugaugcauucugagagcgacgauuuugucaccggccaaccugugcgcuucacgcccaucgggaugggagacaacgauuggcaccagugggagcuccccgacuacuccggccaucugacacuuaauaugaaccuggcuccugccguugcgccggcuuuucccggcgaacggauucucuucuuuagaagcaucgugccuucugccgggggauacggcuccgggcagauugauugccugaucccccaggaguggguccaacacuucuaucaggaagccgcuccuagccagucugccguggcucuuauccgcuacgugaaucccgacaccggacggaacauuuuugaggccaagcugcacagagaaggcuucaucaccguugcgaauagcgggaacaauccuauugucgcucccccgaacggcuauuuucgcuucgaggccugggugaaucaguuuuacacacucaccccuaugggaacaggccaagggcggagacgcaaccaguga

SEQ ID NO: 28379 - RNA, 1644 nt, Artificial Sequence
  derived and/or modified sequence opt5 from capsid_protein__Norovirus__BAL40871
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaaaauacccccagaaugcggcuuguugcuaugcuguacacaccucuccgcgccaacucuggggaugacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccccuaucgacaugcucuauacagaucccaaugagggcauugugguccaaccgcagaacgggagaugcacccuggacggaacacuucagggcaccacgcagcuggugccuacacaaaucugugccuuucgggggacccucauuggacagacaucccgcagcucugauuccaccgacagcgcucccagacggcgcgaucacccucugcauguucagcuuaagaaucuggacggcacccaauacgaccccacagaugaagugccugcgguccucggcgccaucgacuucaaagggacgguguucggagucgcuucucagagagauguguccggccagcagguuggggccacccgggcccacgaggugcacaucaacacaaccgaccccagauauacaccgaagcugggaagcauucugaugcauuccgaaucugaugacuuugucaccggccaaccugugcgcuucacgcccaucgggaugggagauaaugacuggcaccagugggagcuccccgauuacagcggccaucugacacuuaacaugaaucuggcuccugccguugcgccggcuuuucccggcgagcggauucucuucuuuagauccauggugccuagcgccgggggauacggcucugggcagaucgacugccugauuccccaggaauggguccaacacuucuaucaggaggccgcuccuucccagagcgccguggcucuuauccgcuacgugaaccccgauaccggacggaauaucuuugaagccaagcugcacagagagggcuucauuaccguugcgaacucugggaauaacccuaucgucgugcccccgaauggcuauuuucgcuucgaagccugggugaaccaguuuuacacacucaccccuaugggaacaggccaagggcggagacgcaaucaguga

SEQ ID NO: 28380 - RNA, 1644 nt, Artificial Sequence
  derived and/or modified sequence opt5 from capsid_protein__Norovirus__BAL40872
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaaaaucauuuuugcugccguucccccucauuuccccguggaaaacaucuccgcggcccagaucacgaugugcccucacgucauuguggaugugagacagcuggagcccguccugcucccgcugccugacauccggaaucgcuuuuuccauuauaaccaggaagauacccccagaaugcggcuuguugcuaugcuguacacaccucuccgcgccaauucuggggaggacguguuuaccgugagcuguagaguccugacacggcccgcucccgauuucgaguuuaccuuccuugugccuccgacaguugaauccaagaccaaacccuuuacgcugccuauucucacccugggagagcugagcaacucucgcuuccccgccccuaucgacaugcucuauacagaucccaacgaaaccauugugguccaaccgcagaauggcagaugcacacuggacgggacccuucagggaacgacacagcuggugccuacccaaaucuguuccuuucggggcacacucauuagccagaccucucgcuccgccgauagcaccgacucugcucccagaguucggaaccacccucugcaugugcagcuuaagaaucuggaugggacacccuacgacccuacggacgagguccccgcggugcucggagccaucgauuucaaaggcaccgucuucggcguggcuucccaacgcaacacaaccgggaauagcguuggagccacaagagcccacgaagugcacaucgacaccacgaacccgcgguauacaccuaagcugggcuccguccugaugaacucugagagcuccgauuuugacgaugggcagccuaccugcuucacccccauuggaaugggcgcugacgauuggcaucagugggagcuccccgaauacagcgggcaccugacacuuaauaugaaucuggccccggcgguggcucccgccuuuccuggagagagaauccucuucuuucgcucuguugugcccuccgccggcggcuacgggagcggacagauugacugucugaucccucaagaauggguccagcauuucuaucaggaggcugcccccucucagagcgcuguggcccuuauucgguacgugaacccugauaccggcagaaauaucuuugaagcgaagcugcaccgcgagggguucaucacaguugccaacuccggaaauaaccccauugucgugccgccuaauggcuauuuucgguucgaggcuugggugaaccaauuuuacacgcucacccccauggggacaggccagggaagacgccggguccaguga

SEQ ID NO: 28381 - RNA, 1644 nt, Artificial Sequence
  derived and/or modified sequence opt5 from capsid_protein__Norovirus__BAL40873
augaagauggccagcaacgacgcugcccccuccaaugauggcgcggcuaaccuggugccugaggccaauaacgaagucauggcccucgagccgguugcuggggccucuaucgcugcccccguggugggacagcaaaauauuaucgacccuuggauuagagaaaacuucguccaggcgccccagggcgaguuuaccgugagcccuagaaauucccccggggaaaugcugcuuaaccuggagcucggaccugagcugaauccguaccuuucucaccugagccgcauguauaacggcuacgccgggggaaugcagguucaagugguccucgcuggcaaugccuucacagcuggcaaaaucauuuuugccgcggugcccccucauuuccccguugaaaacaucuccgccgcucagaucacgaugugcccucacgugauugucgaugugagacagcuggagcccgugcugcucccgcugccugacauccggaaucgcuuuuuccauuauaaccaggaagauacccccagaaugcggcuugucgccaugcuguacacaccucuccgcgcuaauucuggggaggacguuuuuaccgugagcuguagagugcugacacggcccgcccccgauuucgaguuuaccuuccuugucccuccgacaguggaauccaagaccaaacccuuuacgcugccuauucucacccugggagagcugagcaacucucgcuuccccgccccuaucgacaugcucuauacagaucccaacgaaaccauuguugugcaaccgcagaauggcagaugcacacuggacgggacccuucagggaacgacacagcuggucccuacccaaaucuguuccuuucggggcacacucauuagccagaccucucgcuccgcugauagcaccgacucugcgcccagagugcggaaccacccucugcauguucagcuuaagaaucuggaugggacacccuacgacccuacggacgaggugcccgccguccucggagcuaucgauuucaaaggcaccguguucggcgucgccucccaacgcaacacaaccgggaauagcgugggagccacaagagcucacgaaguucacaucgacaccacgaacccgcgguauacaccuaagcugggcuccgugcugaugcauucugagagcuccgauuuugacgaugggcagcccauuagcuucacccccaucggaaugggcgccgacgauuggcaccagugggagcucccugaauacucugggcaucugacccuuaauaugaaccuggcgccggcugucgcccccgccuuuccuggagagcggauucucuucuuucgcuccgugguucccagcgcuggcggcuacgggucuggacagaucgacugccugauuccucaagaaugggugcagcacuucuaucaggaggccgcucccagccaguccgccgucgcgcuugugcgguacgugaauccugauacaggcagaaacaucuuugaagccaagcugcaccgcgagggguuccucaccguugcuaauucuggaaacaaucccaucgucgugccgccuaacggcuauuuucgguucgaggccugggugaaucaauuuuacacacugacgcccauggggaccggccagggaagacgccggguccaguga

SEQ ID NO: 28382 - RNA, 1626 nt, Artificial Sequence
  derived and/or modified sequence opt5 from capsid_protein__Norovirus__BAL60900
augagaaugagcgacggcgccgcucccaaggccaacggguccgaggcgucuggacaggaucuggugcucaccgcugucgaacaagccguuccuauccagccgguggccggcgcugcccuggcugcccccgcggccgggcagauuaaucagaucgacccuuggauuuuccaaaacuuugugcagugcccccuuggagaguucagcaucuccccucggaauacacccggcgaaauucuguuugaucucgcucuggggccuggacuuaacccguaccuggcccaccucucugcuauguauacgggcugggucggcaauauggaggugcagcugguucuggccgggaacgcguucaccgccggaaaaguggucguggcucucguucccccuuacuuucccaagggcagccugacaaccgcccagaucacauguuucccucaugugaugugcgacguccgcacccuugaacccauccaacugccgcuccuggaugugagacgggugcuuuggcacgcuacacaggaccaggaggaguccaugcgccuggucuguaugcucuauaccccucugagaacgaauagccccggggaugaaucuuuuguuguguccggacggcugcucagcaaaccugccgccgacuucaacuuuguguaccugaccccucccauugagcgcacaaucuauagaauggucgaucuucccgugcugcagccgcggcucugcacccaugcucgcuggcccgcgccuguuuacggccugcuuguggaccccucucugccuuccaauccccaauggcagaacgggagaguccacguggauggaacacuccugggcaccacgccgguuagcggcucuuggguguccuguuucgccgcugaagccgccuaugaguuucagagcgggacaggagaggucgcuaccuucacacugauugaacaagacggcucugccuacgugccuggggagcgggcggcuccccucggauacccugauuuuuccggccagcuggaaaucgagguccagaccgaaaccacaaagcgcggggagaaacuuaaggugacgaccuucgagaugauucugggacccacaaccaauguugaccaggccccuuaucaaggcagaguguacgccagccucuccgcugccgcuucucuggaccuugucgauggccgggugcgcgccguucccagaagcaucuauggguuccaggacgugauuccggaauacaacgauggacugcucgucccucuggcgccucccaucggccccuuucugccgggggaggugcuccugcgguucagaacauauaugcgccagguggacuccagcgaugccgcugccgaagcuaucgacugcgcccuuccccaggaguuuguuucuugguucgcguccaauggauuuaccguccaaagcgaagcccugcuccugcgguacagaaacacgcugacaggccagcuucucuucgaguguaagcuguauucugagggguacauugcucugagcuacuccggcucuggaccucucaccuuucccaccgauggcuucuuugaaguggugagcugggucccucgccuguaucagcuugccuccguggggagccugguuacaggacggacccucaaacaguga

SEQ ID NO: 28383 - RNA, 1623 nt, Artificial Sequence
  derived and/or modified sequence opt5 from capsid_protein__Norovirus__BAQ55211
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccucuacauacagaaugaaccucgccucccagaauuggaacaauuaugaucccacggaggaaauuccugcuccccugggcaccccggacuucguggggaaaauccagggaaugcuuacacagaccacaaagggcgacgggagcacccggggacacaaggcgacggucuccacaggcucuguggauuuuaccccuaaacuggggagcguucaauucgccaccgacacagauaacgacuuugagaccggacagaauacacgcuucacgcccgugggcgucauucaggauggcuccggggcucauagaaacgaaccccaacagugggugcucccuaauuacagcggacggaccguucacaacgugcaccuggccccggccgucgcucccacauuuccuggcgagcagcuucuguucuuucgcucuaccaugcccggguguuccggauacccuaauauggaccucgauugccugcugccccaggaaugggugcaacauuucuaucaggaggccgcgccugcucagagcgacguggcccuccugagauuuguuaaccccgauacaggccggguccuuuucgaguguaagcugcacaaaaccggguacgugacgguggcccauaccggccagcacgaccucgucaucccgccuaauggauauuuuagauucgauucuugggugaaccaauucuacacacuggcucccaugggcaacggggccggacgccggagagcucuuuga

SEQ ID NO: 28384 - RNA, 1623 nt, Artificial Sequence; identical to SEQ ID NO: 26788
  derived and/or modified sequence opt5 from capsid_protein__Norovirus__BAQ55212

SEQ ID NO: 28385 - RNA, 1620 nt, Artificial Sequence
  derived and/or modified sequence opt5 from capsid_protein__Norovirus__BAQ55213
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccuccacauacagaaugaaccucgccagccagaauuggaacaauuaugauccuacggaggaaauucccgcuccucugggcacccccgacuucguggggaaaauccagggaaugcuuacacagaccacaaagggcgacggguccacccggggacacaaggcgacggucucuacaggcagcguggauuuuaccccgaaacugggguccguucaauucgacaccgauacaaacaaugaccucgagaccggacagaacacacgcuuuacgccugugggcgucauucaggauggcagcgcccauagaaaugaaccccaacagugggugcugcccgacuacucugggcggaccguucacaacgugcaccuugcuccugccgucgccccgacauuccccggagagcagcugcucuuuuuccgcuccaccaugccuggcuguagcggguaccccaauauggaucuggacugccugcucccucaggaaugggugcaacauuuuuaucaggaggcugcccccgcgcagucugauguggcucugcuuagauucguuaacccugacacaggacggguccuguuugaguguaagcuccacaaaaccggcuacgugacgguggcccauaccgggcagcacgaucuggucauucccccgaauggcuauuucagauuugacagcugggugaaccaauucuacacacuugccccuaugggaaacggcgcugggcgccggagagcccuguga

SEQ ID NO: 28386 - RNA, 1623 nt, Artificial Sequence
  derived and/or modified sequence opt5 from capsid_protein__Norovirus__BAQ55214
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcaccuccacauacagaaugaaccucgccagccagaauuggaacaauuaugauccuacggaggaaauucccgcuccucugggcacccccgacuucguggggaaaauccagggaaugcuuacacagaccacaaagggcgacggguccacccggggacacaaggcgacggucucuacaggcagcguggauuuuaccccgaaacugggguccguucaauucgccaccgacacagauaacgacuuugagaccggacagaauacacgcuucacgccugugggcgucauucaggauggcagcggggcucauagaaacgaaccccaacagugggugcuccccgacuacucuggaaagaccguucacaaugugcaccuggccccugccgucgcuccgacauuucccggcgagcagcuucuguucuuucgguccaccaugccuggguguagcggauaccccaacauggaucucgacugccugcugccucaggaaugggugcaacauuucuaucaggaggccgcgcccgcucagucugauguggcccuccugcgcuuuguuaauccugacacaggcagaguccuuuucgaguguaaacugcacaagaccggguacgugacgguggcccauaccggccagcacgaucucgucauucccccgaacggauauuuucgguucgacagcugggugaaucaauucuacacacuggcuccuaugggcaacggggccggaagacgccgggcucuuuga

SEQ ID NO: 28387 - RNA, 1620 nt, Artificial Sequence
  derived and/or modified sequence opt5 from capsid_protein__Norovirus__BAQ55215
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuggcaccagaacauaccggaugaaccucgccucucagaauuggaacaauuaugaucccacggaggaaauuccugcuccccugggcaccccggacuucguggggaaaauccagggaaugcuuacacagaccacaaagggcgacggguccacccgcggacacaaggcgacggucagcacaggcuccguggauuuuaccccuaaacuggggucuguucaauucgacaccgauacaaacaaugaccucgagaccggacagaacacaagauuuacgcccgugggcgucauucaggauggcagcgcccaucggaaugaaccccaacagugggugcugccugacuacuccgggcgcaccguucacaacgugcaccuugcuccggccgucgcccccacauucccuggagagcagcugcucuuuuucagaagcaccaugcccggcuguucuggguacccuaauauggaucuggacugccugcucccccaggaaugggugcaacauuuuuaucaggaggcugccccugcgcaguccgauguggcucugcuucgguucguuaaccccgacacaggaagaguccuguuugaguguaagcuccacaaaaccggcuacgugacgguggcccauaccgggcagcacgaucuggucaucccgccuaauggcuauuuccgcuuugacagcugggugaaccaauucuacacacuugcccccaugggaaacggcgcugggcggagacgcgcccuguga

SEQ ID NO: 28388 - RNA, 1620 nt, Artificial Sequence
  derived and/or modified sequence opt5 from capsid_protein__Norovirus__BAQ55216
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucagaucacaauguucccgcauauuaucguggacgucagacaacucgagccugugcugauuccccugccugaugugcggaacaauuuuuaucacuacaaccagagcaaugacuccaccaucaagcucauugcuaugcuguauacaccccuucgcgccaacaacgcuggcgaugacgucuucaccguuagcugcagagugcugacacggcccucuccugauuuugacuucaucuuucucgugccgcccaccgucgaaucccgcacgaaaccuuucaccgugcccauucugacaguugaggaaaugaccaauagcagauuuccuaucccccuugagaagcuguucacagggccgucuuccgccuucgugguccagccucagaacggacgguguaccacggauggcgugcuccuggggacaacccaacugagccccguuaauaucugcacauuucgcggagacgugacccauauuccuggcaccagaacauaccggaugaaccucgccucucagaauuggaacaauuaugaucccacggaggaaaucccugcuccccugggcaccccggacuucgucgggaaaauucagggaaugcuuacacagaccacaaagggcgacggguccacccgcggacacaaggcgacggugagcacaggcuccgucgauuuuaccccuaaacuggggucugugcaauucgacaccgauacaaacaaugaccucgagaccggacagaacacaagauuuacgcccguuggcgugauccaggauggcagcgcccaucggaaugaaccccaacaguggguccugccugacuacuccgggcgcaccgugcacaacguucaccuugcuccggccguggcccccacauucccuggagagcagcugcucuuuuucagaagcaccaugcccggcuguucuggguacccuaauauggaucuggacugccugcucccccaggaauggguccaacauuuuuaucaggaggcugccccugcgcaguccgauguggcucugcuucgguucgugaaccccgacacaggaagaguucuguuugaguguaagcuccacaaaaccggcuacgucacgguggcccauaccgggcagcacgaucuggugauuccgccuaauggcuauuuccgcuuugacagcugggucaaccaauucuacacacuugcccccaugggaaacggcgcugggcggagacgcgcccuguga

SEQ ID NO: 28389 - RNA, 1620 nt, Artificial Sequence
  derived and/or modified sequence opt5 from capsid_protein__Norovirus__BAQ55217
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucucuggcacccacacauacagaaugaaccucgccucccagaauuggaacaauuaugauccuacggaggaaauucccgcuccucugggcacccccgacuucguggggaaaauccagggaaugcuuacacagaccacaaagggcgacgggagcacccggggacauaaggcgacggucuccacaggcucuguggauuuuaccccgaaacuggggagcguucaauucgccaccgacacaaacaaugauuuugagaccggacagaacacacgcuucacgccugugggcgucauucaggacggcuccgcucacagaaaugaaccccaacagugggugcuccccgauuacagcgggaagaccguucacaacgugcaucuggccccugccgucgcuccgacauuucccggagagcagcuucuguucuuucggucuaccaugccuggcuguuccggguaccccaauauggaccucgauugccugcugccucaggaaugggugcaacacuucuaucaggaggccgcgcccgcucagagcgacguggcccuccugcgcuuuguuaacccugauacaggaagaguccuuuucgaguguaaacugcauaagaccggcuacgugacgguggcccacaccgggcagcacgaccucgucauucccccgaauggcuauuuucgguucgauucuugggugaaccaauucuacacacuggcuccuaugggaaacggcgccgggagacgccgggcucuuuga

SEQ ID NO: 28390 - RNA, 1623 nt, Artificial Sequence
  derived and/or modified sequence opt5 from capsid_protein__Norovirus__BAQ55218
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugaccaauagcagauuuccuauuccccuugagaagcuguucacagggccgucuuccgccuucgucgugcagccucagaacggacgguguaccacggauggcguucuccuggggacaacccaacugagccccgugaauaucugcacauuucgcggagacgucacccauaucccuaacacccacacauacagaaugaaucucgccucucagaacuggaauaacuaugaucccacggaggaaauuccugcuccccugggcaccccggacuucgugggcaaaauccaggggaugcuuacacagaccacaaagggagacggcuccacccgggggcauaaggcgacggucagcacaggauccguggauuuuaccccuaaacugggcucuguucaauucaccacagacaccgauaaugacuuugagacagggcagaacacgcgcuucacccccgugggagucauucaggauggcaauggcgcccacagaaacgaaccccaacagugggugcucccugacuacagcgggggaacaguucacaaugugcaucuggcuccggccgucgcccccaccuuuccuggcgagcagcuucuguucuuucgguccacaaugcccggguguagcggauacccuaacauggaucucgacugccugcugccccaggaaugggugcaacacuucuaucaggaggcugccccugcgcagucugauguggcucuccugcgcuuuguuaaucccgacaccggcagaguccuuuucgaguguaagcugcauaaaacgggguacgugaccguggcccacacaggccagcacgaucucgucaucccgccuaacggauauuuucgguucgacuccugggugaaccaauucuacacccuggcccccaugggcaauggggcuggaagacgccgggcccuuuga

SEQ ID NO: 28391 - RNA, 1623 nt, Artificial Sequence; identical to SEQ ID NO: 27001
  derived and/or modified sequence opt5 from capsid_protein__Norovirus__BAR47396

SEQ ID NO: 28392 - RNA, 1623 nt, Artificial Sequence; identical to SEQ ID NO: 27492
  derived and/or modified sequence opt5 from capsid_protein__Norovirus__BAR47397

SEQ ID NO: 28393 - RNA, 1623 nt, Artificial Sequence
  derived and/or modified sequence opt5 from capsid_protein__Norovirus__BAR47398
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcggcccugaacuggaauaacuaugacccuaccgaagagauucccgcuccucuugggacacccgauuucgugggaaaaauccagggcguccugacgcagaccacaaaggccgacgggucuacccggggacacaaggccacaguguacaccggcuccgcugacuuuacgccgaaacucgggagcguucaguucuccacagauaccgaaaaugacuuugagacccaucaaaacacaaaguucaccccugugggagucauucaggauggcucuacaacgcaccgcaaugaaccccagcaaugggugcugcccagcuacuccggcagaaacguucacaaugugcaucuugccccugcggucgcuccgaccuuucccggggagcagcuccuguucuuucggagcacaaugccuggauguucuggcuaucccaacauggaccuggauugccugcucccucaggagugggugcagcacuucuaccaagaagccgcccccgcucaguccgacguggcccugcuucgcuuuguuaauccugaucaggggagaguccuguucgaguguaaacuccauaagagcggauaugugaccguggcucacacaggccagcacgaccuggucauucccccgaacggguacuuucgguucgauucuugggugaaccaauucuauacccuugccccuaugggcaauggaacgggcagacgccgggcgcuguga

SEQ ID NO: 28394 - RNA, 1623 nt, Artificial Sequence; identical to SEQ ID NO: 27532
  derived and/or modified sequence opt5 from capsid_protein__Norovirus__BAR47400

SEQ ID NO: 28395 - RNA, 1623 nt, Artificial Sequence
  derived and/or modified sequence opt5 from capsid_protein__Norovirus__BAR47401
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccacccugacaguggaagagaugaccaacuccagauuuccuaucccccuugagaagcuguucacagggccgagcucugccuucgucgugcagccucagaauggacgguguaccacggacggcguucuccuggggacaacccaacugucccccgugaacauuugcacauuucgcggagaugucacccauaucgcuggcagcagagacuacaccaugaaucucgcgucucugaacuggaauaacuaugauccuacagaagagauccccgccccucuuggcacgcccgacuucguggggaaaauucagggaguccugacccagacaaccaagggcgacggguccacacggggacacaaggcuaccguguacacgggcagcgccccguuuacaccuaaacucggguccguucgcuucucuaccgauaccgaaaaugacuuugagacacaucagaacaccaaguucacacccgugggagucauccaagauggcagcacgacccacagaaaugaaccccagcagugggugcugccuuccuacagcggccgggacguucacaacgugcaucuugccccggcugucgcccccacauuuccuggggagcaacuccuguucuuucgcucuaccaugcccggauguuccggcuauccuaauauggaucuggacugccugcucccccaggagugggugcagcacuucuaccaggaagcggcuccugcccaaagcgauguggcccugcuuagauuuguuaaccccgacacagggcggguccuguucgaguguaaacuccauaagucuggauaugugaccguggcucacacgggccagcacgaucuggucauuccgccuaauggguacuuuagauucgacagcugggugaaccaguucuauacccuugcccccaugggcaacggaacaggccgccggagagcucuguga

SEQ ID NO: 28396 - RNA, 1623 nt, Artificial Sequence
  derived and/or modified sequence opt5 from capsid_protein__Norovirus__BAR47403
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaauuuacaccggcagcgccccguuuacgccuaaacucggguccgugcaguucucuacagacaccgaaaacgauuuugagacccaucaaaauacaaaguucacccccguuggagugauccaggacggcggcacaacgcaccgcaacgaaccccagcaauggguccugccuagcuacuccgggagagaugugccgaauguucaccuugcccccgcuguggccccuaccuuucccggagagcagcuccuguucuuucggagcacaaugccuggcuguucuggguaucccaacauggaccuggauugccugcucccucaggaguggguccagcauuucuaccaagaagcggcucccgcccaguccgacguggcccugcuucgcuuugugaauccggauaccggaagaguucuguucgaguguaaacuccacaagagcggcuaugucacaguggcucauaccgggcagcacgaccuggugauuccucccaacggcuacuuucgguucgauucuugggucaaccaguucuauacgcuugccccuaugggaaauggcaccgggagacgccgggcucuguga

SEQ ID NO: 28397 - RNA, 1623 nt, Artificial Sequence; identical to SEQ ID NO: 27081
  derived and/or modified sequence opt5 from capsid_protein__Norovirus__BAR47404

SEQ ID NO: 28398 - RNA, 1623 nt, Artificial Sequence
  derived and/or modified sequence opt5 from capsid_protein__Norovirus__BAR47405
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaaugcugacgcagaccacaaagggcgacgggagcacccggggacacaaggcuacagucuacaccggcuccacgccguuuacaccuaaacucgggucugugcaguucagcaccgacaccgaaaaugauuuugagacacaucaaaacaccaaguucacacccguuggagugauucaggacggcuccacgacccaccgcaaugaaccccagcaauggguccugccuagcuacucuggcagaaacgugccgaauguucaccuugcccccgccguggcuccuacauuucccggggagcagcuccuguucuuucgguccaccaugccuggauguagcggcuaucccaacauggaucuggacugccugcucccucaggaguggguccagcauuucuaccaagaagccgcgcccgcucagucugauguggcccugcuucgcuuugugaauccggacacagggagaguucuguucgaguguaaacuccacaagagcggauaugucaccguggcccauacgggccagcacgaucuggugaucccucccaacggguacuuucgguucgacuccugggucaaccaguucuauacccuugcuccuaugggcaauggaacaggcagacgccgggcccuguga

SEQ ID NO: 28399 - RNA, 1623 nt, Artificial Sequence; identical to SEQ ID NO: 27691
  derived and/or modified sequence opt5 from capsid_protein__Norovirus__BAR47406

SEQ ID NO: 28400 - RNA, 1623 nt, Artificial Sequence
  derived and/or modified sequence opt5 from capsid_protein__Norovirus__BAR47407
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuggcaacuacaccaugaaucucgcguccgugaacuggaauaacuaugacccuaccgaagagauucccgccccucuggggacacccgauuucgucggaaaaauccagggcaugcuuacgcagaccacaaagggggacggaagcaccagaggccacaaggcuacaguguacaccggguccgccccguuuacgccuaaacugggaucuguucaguucagcacagacaccgaaaaugauuuugagacccaucaaaacacaaaguucacccccgugggcgucauucaggacggcaauacaacgcaccggaacgaaccccagcaaugggugcucccuuccuacagcgggcgcaauguuccgaacgugcaccuggcccccgcugucgccccuaccuuucccggagagcagcuucuguucuuuagaucuacaaugccuggcuguuccggguaucccaauauggaucucgacugccugcugccucaggagugggugcagcauuucuaccaagaagcggcucccgcccagagcgauguggcccuccugcgguuuguuaacccggacaccggacgcguccuuuucgaguguaaacugcacaagucuggcuaugugacaguggcucauaccgggcagcacgaucucgucaucccucccaacggcuacuuuagauucgacagcugggugaaucaguucuauacgcuggccccuaugggaaacggcaccgggcggagacgcgcucuuuga

SEQ ID NO: 28401 - RNA, 1623 nt, Artificial Sequence
  derived and/or modified sequence opt5 from capsid_protein__Norovirus__BAR47408
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucaaaaacaauuucguucaggcccccggcggggaauuuaccgugagcccuagaaacgcgcccggagagauucugugguccgccccucuuggcccggaucugaaucccuaccucucucaccuggcucggauguauaacggguacgccggaggcuucgaaguccaggugauccuugcuggcaaugccuuuacagcggggaagauuaucuucgccgcuguuccucccaacuuuccuacggagggacugagccccucccaggugaccauguucccgcauaucauugucgacgugcgccaacucgagccugugcugaucccccugccugaugucagaaauaacuuuuaucacuacaaucagucuaacgacagcacaauuaaacucaucgccaugcuguauacaccccuucgggcuaacaaugccggcgaagauguuuucaccguguccugccgcgugcugaccagacccagcccugacuuugauuucauuuuucucgucccgcccacaguggagucucggaccaagccuuucacgguucccauccugaccguggaagagaugacaaacucccgcuuuccuauuccccuugagaaacuguucaccgggccgagcggagccuucgucgugcagccucagaauggcagauguacaaccgacgggguucuccugggaacgacacaacugucucccgugaacaucugcaccuuucggggcgaugucacacauaucgcuggcucccgcaauuacaccaugaaccucgcggcccugaauuggaacaauuaugacccuaccgaagagauucccgcuccucuugggacacccgauuucgugggaaagauccagggcguccugacgcagaccacaaagggggacggaagcaccagaggccacaaagccacaguguacaccgggucugccgacuuuacgccgaagcucggauccguucaguucagcacagauaccgaaaacgacuuugagacccaucaaaauacaaaauucaccccugugggcgucauucaggauggcuccacaacgcaccggaacgaaccccagcaaugggugcugcccucuuacagcgggcgcaauguucacaacgugcaucuugcuccugccgucgcgccgaccuuucccggagagcagcuccuguucuuuagauccacaaugccuggcuguagcggguaucccaauauggaccuggauugccugcucccucaggagugggugcagcacuucuaccaagaagcugcccccgcccagucugacguggcucugcuucgguuuguuaacccugauaccggacgcguccuguucgaguguaagcuccauaaauccggcuaugugacaguggcccacaccgggcagcacgaccuggucauucccccgaacggcuacuuuagauucgauagcugggugaaucaguucuauacgcuugcuccuaugggaaacggcaccgggcggagacgcgcccuguga

SEQ ID NO: 28402 - RNA, 1623 nt, Artificial Sequence; identical to SEQ ID NO: 27817
  derived and/or modified sequence opt5 from capsid_protein__Norovirus__BAR47410

SEQ ID NO: 28403 - RNA, 1623 nt, Artificial Sequence
  derived and/or modified sequence opt5 from capsid_protein__Norovirus__BAR47412
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagaauccaauucgagacagacaccgaucaugacuuugaagccaaucagaacaccaaauucacacccguggggguuauucaggauggaggcaccacacaccggaaugagccccaacagugggugcucccuucuuacagcggccgcaacacgcacaauguccaucuggcuccggccguggcgcccaccuuuccuggggaacagcuucuguucuuuagauccacaaugcccggauguagcggcuauccuaacauggaccucgauugccugcugccccaggagugggugcaauacuucuaucaggaggcugccccugcccagucugacguugcucuccugcgguuugucaaucccgauaccgggagagugcuuuucgaauguaagcugcacaaauccggauacgugacagucgcccauaccggccagcacgaccucgugaucccgccuaacggguauuuucgcuucgauagcuggguuaaccaauucuacacgcuggcucccaugggcaauggaaccggccggagacgcguggccuga

SEQ ID NO: 28404 - RNA, 1623 nt, Artificial Sequence
  derived and/or modified sequence opt5 from capsid_protein__Norovirus__BAR47413
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagaauccaauucgagacagacaccgaucaugacuuugaagccaaucagaacaccaaauucacacccguggggguuauucaggauggaggcaccacacaccggaaugagccccaacaguggaugcucccuucuuacagcggccgcaacacgcacaaugugcaucuggcuccggccgucgcgcccaccuuuccuggggaacagcuucuguucuuuagauccacaaugcccggauguagcggcuauccuaacauggaccucgauugccugcugccccaggagugggugcaauacuucuaucaggaggcugccccugcccagucugacguggcucuccugcgguuuguuaaucccgauaccgggagaguccuuuucgaauguaagcugcacaaauccggauacgugacaguggcccauaccggccagcacgaccucgucaucccgccuaacggguauuuucgcuucgauagcugggugaaccaauucuacacgcuggcucccaugggcaauggaaccggccggagacgcguugccuga

SEQ ID NO: 28405 - RNA, 1623 nt, Artificial Sequence; identical to SEQ ID NO: 28404
  derived and/or modified sequence opt5 from capsid_protein__Norovirus__BAR47414

SEQ ID NO: 28406 - RNA, 1623 nt, Artificial Sequence; identical to SEQ ID NO: 28404
  derived and/or modified sequence opt5 from capsid_protein__Norovirus__BAR47415

SEQ ID NO: 28407 - RNA, 1623 nt, Artificial Sequence; identical to SEQ ID NO: 27331
  derived and/or modified sequence opt5 from capsid_protein__Norovirus__BAR47417

SEQ ID NO: 28408 - RNA, 1623 nt, Artificial Sequence
  derived and/or modified sequence opt5 from capsid_protein__Norovirus__BAR47418
augaagauggccagcuccgacgcuaaucccccugauggcucugccgcgaaccuggugccggaggucaacaaugaaguuauggcucucgagcccguggugggggccgccaucgcugccccugucgcuggacagcaaaacgugauugaccccuggaucagaaauaacuucguucaggccccuggcggggaauuuaccgugagcccccggaaugcgccuggagagauucugugguccgccccgcuuggccccgaucugaacccuuaccucucucaccuggcucgcauguauaauggguacgccggaggcuucgaaguccaggugauccuugcuggcaacgccuuuacagcggggaaaguuauuuucgccgcugugcccccuaauuuucccacggagggacugagcccgucccaggucaccauguucccucauaucgugguggacgucagacaacucgagcccguucugaucccucugcccgaugugcggaacaauuuuuaucacuacaaccagucuaaugaccccacaauuaagcucaucgccaugcuguauaccccucuucgcgcuaacaacgccggcgaugacguguucacagucagcugcagagugcugacccggccgucccccgauuuugacuucauuuuucucguuccucccacaguggaaagccgcaccaaaccuuucucuguccccgugcugacgguugaggaaaugaccaauuccagauuuccgaucccucuugagaagcuguucacagggcccagcucugccuucgugguccagccucagaacggacgguguaccacagauggcgugcuccuggggaccacgcaacugucccccgucaauauuugcacauuucgcggagacgugacccauaucacaggcagccacaacuacaccaugaaucucgcuucucagaacuggaauaacuaugauccuaccgaggaaauucccgcgccgcugggcacaccugacuucguugggaaaauccagggagugcuuacgcagaccacaagaaccgacggcuccacacgggggcauaaggccaccgucuacacgggaagcgcugauuuugcccccaagcugggccgcgugcaauucgagacagacaccaaucacgauuuugaagccaaccagaauaccaaauucacacccguuggggugauccaggacggaggcaccacacacagaaacgagccucaacaguggguccucccguccuacucuggccggaauacgcauaacgugcaccuggcucccgccguggcgccuaccuuucccggggaacagcuucuguucuuucgcagcacaaugccuggauguuccggcuaucccaauauggaucucgacugccugcugccucaggaguggguucaauacuucuaucaggaggcugcccccgcccagagcgaugucgcucuccugagauuugugaacccggacaccgggcgggugcuuuucgaauguaagcugcauaaaucuggauacgucacaguggcccacaccggccagcacgaucucguuauuccucccaacggguauuuuagauucgacuccugggugaaucaauucuacacgcuggcuccuaugggcaacggaaccggccgccggagagccgucuga

SEQ ID NO: 28409 - RNA, 1623 nt, Artificial Sequence
  derived and/or modified sequence opt5 from capsid_protein__Norovirus__BAR47421
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaggcaccacacaccggaacgagccccaacaguggguccucccuagcuacuccggccgcaauacgcacaacgugcaucuggcuccggccguggcgcccaccuuuccuggggaacagcuucuguucuuuagaagcacaaugcccggauguucuggcuauccuaauauggaccucgauugccugcugccccaggaguggguucaauacuucuaucaggaggcugccccugcccaguccgacgucgcucuccugcgguuugugaaccccgauaccgggagagugcuuuucgaauguaagcugcacaaaagcggauacgucacaguggcccauaccggccagcacgaccucguuauuccgccuaauggguauuuucgcuucgauucuugggugaaccaauucuacacgcuggcucccaugggcaacggaaccggccggagacgcgccgucuga

SEQ ID NO: 28410 - RNA, 1623 nt, Artificial Sequence; identical to SEQ ID NO: 27137
  derived and/or modified sequence opt5 from capsid_protein__Norovirus__BAR47422

SEQ ID NO: 28411 - RNA, 1623 nt, Artificial Sequence
  derived and/or modified sequence opt5 from capsid_protein__Norovirus__BAR47423
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucgggacuuugaagccaaucagaacaccaaauucacacccguuggggugauccaggauggaggcaccacacaucgcaaugagccccaacaguggguccucccuucuuacagcggcagaaacacgccgaaugugcaccuggcucccgccguggcgccuaccuuucccggggaacagcuucuguucuuucgguccacaaugccuggauguagcggcuaucccaacauggaccucgauugccugcugccucaggaguggguucaauacuucuaucaggaggcugcccccgcccagucugacgucgcucuccugagauuugugaauccggauaccgggcgcgugcuuuucgaauguaagcugcacaaauccggauacgccacagucgcucauaccggccagcacgaccucgugauuccucccaacggguauuuucgguucgauagcuggguuaaccaauucuacacgcuggccccuaugggcaauggaaccggcagacgccgggcgcuuuga

SEQ ID NO: 28412 - RNA, 1623 nt, Artificial Sequence; identical to SEQ ID NO: 27139
  derived and/or modified sequence opt5 from capsid_protein__Norovirus__BAR47424

SEQ ID NO: 28413 - RNA, 1623 nt, Artificial Sequence; identical to SEQ ID NO: 27417
  derived and/or modified sequence opt5 from capsid_protein__Norovirus__BAR47426

SEQ ID NO: 28414 - RNA, 1623 nt, Artificial Sequence; identical to SEQ ID NO: 27081
  derived and/or modified sequence opt5 from capsid_protein__Norovirus__BAS53731

SEQ ID NO: 28415 - RNA, 1623 nt, Artificial Sequence
  derived and/or modified sequence opt5 from capsid_protein__Norovirus__BAS53732
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcgccaaaccuuucaccguucccauccugacgguggaggaaaugaccaacuccagauuuccuauuccccuugagaagcuguucacagggccgagcucugcuuucgucgugcagccucagaauggacgguguaccacagauggcguucuccuggggaccacgcaacugucccccgugaacaucugcacauuucgcggagacgucacccauaucgcgggcagcagaaauuacacaaugaaccucgccucucugaauuggaacaauuaugauccuaccgaggaaauucccgcuccucuuggcacccccgacuucguggggaaaauccagggaguccugacacagacgaccaagggcgacggguccacacggggacacaaggccaccguguacacaggcagcgccgauuuuaccccgaaacucggguccguucaguucggaacggacacagagaacgauuuugaaacccaucaaaauaccaaguucacaccugugggcgucauucaggacggcgggaccacacaccgcaacgagccccagcaaugggugcugcccucuuacagcggaagaaauguucacaacgugcaucuugcuccugccgucgcgccgaauuuucccggcgaacagcuccuguucuuucgguccacgaugccuggguguagcggauaucccaacauggaucuggacugccugcucccucaggagugggugcagcacuucuaccaagaggcugcccccgcccagucugauguggcucugcuucgcuuuguuaacccugacaccggcagaguccuguucgaauguaaacuccauaaguccggguaugugacaguggcccacaccggccagcacgaucuggucauucccccgaauggauacuuucgguucgacagcugggugaaccaguucuauacacuugcuccuaugggcaaugggaccggaagacgccgggcccuguga

SEQ ID NO: 28416 - RNA, 1623 nt, Artificial Sequence
  derived and/or modified sequence opt5 from capsid_protein__Norovirus__BAS53733
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuaucgagggacugagccccucccaggugacgauguucccgcauauuaucgucgacgugagacaacucgagccugugcugauuccccugccugauguccggaauaacuuuuaucacuacaaucagucuaacgacagcaccaucaagcucauugccaugcuguauacaccccuucgcgcuaacaaugccggcgaugacguuuucaccguguccugcagagugcugacacggcccagcccugauuuugacuucaucuuucucgucccgcccaccguggaaucucgcacaaaaccuuucaccguucccauucugacgguggaggaaaugaccaacuccagauuuccuaucccccuugagaagcuguucacagggccgagcucugccuucgucgugcagccucagaauggacgguguaccacagauggcguucuccuggggaccacgcaacugucccccgugaacaucugcacauuucgcggagacgucacccauauugcuggcagcagaaauuacacaaugaaccucgcgucucuguccuggaauaacuaugauccuaccgaggaaauccccgccccucuuggcacccccgacuucguggggaaaauucagggaguccugacacagacgaccaagggcgacgggagcacacggggacacaaggcuaccguguacacaggcuccgccccguuuaccccuaaacucgggucuguucaguucagcacggauacagagaaugacuuugaaacccaucaaaacaccaaguucacacccgugggagucauccaggauggcggcaccacacaccgcaaugagccccagcaaugggugcugccuuccuacagcgggagaaacguuccgaaugugcaccuugcccccgcugucgccccuacguuucccggagaacagcuccuguucuuucggucuaccaugccuggcuguuccggguaucccaacauggaccuggauugccugcucccucaggagugggugcagcauuucuaccaagaggcggcucccgcccagagcgacguggcccugcuucgcuuuguuaauccggauacaggaagaguccuguucgaauguaaacuccacaagucuggcuaugugaccguggcucauacagggcagcacgaccuggucauuccucccaacggcuacuuucgguucgauagcugggugaaccaguucuauacccuugccccuaugggaaauggcacggggagacgccgggcucuguga

SEQ ID NO: 28417 - RNA, 1623 nt, Artificial Sequence
  derived and/or modified sequence opt5 from capsid_protein__Norovirus__BAS53734
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucggaacagacaccgagaacgauuuugaaacccaucaaaauacaaaguucaccccugugggcgucauucaggacggcucuacaacgcaccgcaacgagccccagcaaugggugcugcccagcuacuccgggagaaauguucacaacgugcaucuugccccugcugucgccccgaauuuucccggagaacaguuccuguuuuuccggagcaccaugccuggcuguucuggguaucccaacauggaucucgacugccugcugccucaggagugggugcagcacuuuuaccaagaggcggcucccgcccaguccgauguggcccuccugcgcuucguuaacccugacacaggaagaguccuuuuugaauguaaacugcauaagagcggcuaugugaccguggcucacacagggcagcacgaucucgucauucccccgaauggcuacuuccgguucgacucuugggugaaccaguuuuauacccuggccccuaugggaaauggcacggggagacgccgggcucuuuga

SEQ ID NO: 28418 - RNA, 1623 nt, Artificial Sequence
  derived and/or modified sequence opt5 from capsid_protein__Norovirus__BAS53945
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugaccacacccucuccugacuuugauuucauuuuucucgucccgcccaccguggagucccggacgaaaccuuucaccguucccauccugacaguggaagagaugaccaauagccgcuuuccuauuccccuugagaagcuguucacagggccgucuuccgccuucgucgugcagccucagaacggaagauguaccacggacggcguucuccuggggacaacccaacugagccccgugaauaucugcacauuucggggagaugucacccauaucgcuggcucucgcaacuacaccaugaaucucgcgucccugaacuggaauaacuaugacccuacagaagagauucccgccccucuuggcacgcccgauuucguggggaaaauccagggaaugcugacccagacaaccaagggcgacgggagcacaagaggacacaaggcuaccgucuacacgggcuccgccccguuuacaccuaaacucgggucugugcaguucagcaccgacaccgaaaaugauuuugagacacaucaaaacaccaaguucacacccguuggagugauucaggacggcaauacgacccaccggaacgaaccccagcaauggguccugccuuccuacagcggccgcaaugugccgaacguucaccuugcccccgcuguggccccuacauuucccggggagcagcuccuguucuuuagaucuaccaugccuggauguuccggcuaucccaauauggaucuggacugccugcucccucaggaguggguccagcauuucuaccaagaagcggcucccgcccagagcgauguggcccugcuucgguuugugaacccggacacagggcgcguucuguucgaguguaaacuccacaagucuggauaugucaccguggcucauacgggccagcacgaucuggugaucccucccaacggguacuuuagauucgacagcugggucaaucaguucuauacccuugccccuaugggcaacggaacaggccggagacgcgcucuguga

SEQ ID NO: 28419 - RNA, 1632 nt, Artificial Sequence
  derived and/or modified sequence opt5 from capsid_protein__Norovirus__CAK22261
augaugauggccagcaaggacgcuucccccucugccgauggcgcgaacggggcuggacagcuggugccugaggucaauaacgccgaaccgcucccccuggacccuguugccggcgcuagcaccgcccuugcuacagccgggcaagugaauaugaucgaucccuggaucuucaacaauuuugugcaggcgccucagggagaguucacgaucucccccaacaauaccccuggcgacauucuguuugaucuccagcuggggccgcaccuuaaccccuuccuggcccaucucucucaaauguacaauggaugggucggcaacaugagagugcggguuauccuggcuggcaaugccuuuacagcugggaaagugauugucugcugugugccucccggauuccagagccgcacccuguccaucgcccaggcgacacucuuuccucacaucauugccgacguuagaacccuggaacccaucgagauuccgcuugaagaugugcggaacacacuguaucauaccaaugacaaccagccuacgaugcgccuccugugcaugcuuuacacaccccugagaaccggcgggggaucuggcgggaccgaugcuuucgucguggccggacgggugcucacauguccuagcuccgacuuuaauuuccuguuucuggucccucccaccguugagcaaaagacgcgccccuucagcgugccgaacaucccccuccagcugcuuucuaacuccagagugccuaaucugauucagagcaugguccucucucccgaucaggcucaaaacgugcaguuucagaauggccggugcacaaccgacggccaacugcuugggacaaccccuguuuccgugagccagauccugaaauuccgcggaaaggucucugccggcuccagagugauuaaccucaccgagcuggaugggagccccuuccuggccuuugaagcuccggcgccuacaggauuccccgaccucggcacguccgacuggcacguugagaugucucugaauagcaacucccagagcucugggaauccuauccuucugcgggauauccagcccaacuccagcgacuuugugccucaucucggaucugucgccgugaccacagcuauugaugucgccggcgacuauaccggcacaauccaauggaccagccagcccuccaaugugacgccgguuccugaugugaacuucuggacaauuccccaguacgggucuaaucuggccgaagcuagccagcuugcccccgucguguauccuccgggauuuggcgaggcgaucguuuacuucaugucccccauuccugggcccaacaccgcucacaaaccuaaucuggugcccugucuccugccucaagaguuugucacccacuucgugagcgaacaggcccccucuaugggagaggccgcucuggugcauuauguugacccggauacaaaccgcaaucucggcgaauuuaagcuguacccugagggguucauuaccugcguccccaacggcacaggaccucagcagcuuccccugaacggcguguuuguguucgccuccugggucagcagauuuuaccaacucaagccgguggggacggcuucuuccgcccggggacgccugggcguuagacgguga

SEQ ID NO: 28420 - RNA, 1671 nt, Artificial Sequence
  derived and/or modified sequence opt5 from capsid_protein__Norovirus__CAR95870
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgcugggggaaucgacgugauggucgugcuggccggcaaugcuuucaccgccggcaagguucugauugcugccaucccucccaacuuuccuguggagggggucucugcgagccaagccacacaguucccccaugugaucauugaugugcggacccucgacccgguccgccugccucuucccgauguuagauccacauuuuuccacuauaccaaugacacagagccuaaaaugcggcuggugaucuggcucuacacgccccugcgcaccaacggaagcggcgaugacucuuuuaccguguccgggcggauucuuacaagacccagccaggauuucgaauuugcuuuccugaucccuccgaccgucgagacaaagaccacgcccuuuucugugccuggauucuccguucaggaaaugagcaauucucgcuggcccgccgcuauuuccgccaugguggucagaggcaacgagccucaagugguucaguuucagaaugggcgggcccaucucgacggaaugcugcugggcacaacccccgugagcccgaacuauaucgcuuccuaccgcggcauuucuacagggaauagcagauccgcgagcucugaggccgaugaacgggcugucggauccuucgacguguggguccgccuccaggagccugacggccaacccuaugauaucuucgggaagcagccugcccccaucggaaccccugacuuuaaagccgugauuguuggcuucgcugccagaccccugaccagcgggucuuacgcgaacgaagcguacgugaacacaacggccagcgauuaugccccggcuaccggaaauaugcgguuuacaguccgcaacggcggcaccgggcacaucuccgccaauaaguacugggaguucaaaucuuuuggaguggaaggcgagagacauacaaacauucaguaucaagaguacgaacuuccugacuauagcgggcagguugcuuccaaucacaaccuggccccucccguggcgccccggaugccgggagagagccuccugcuuuuccagucuaauaugcccgucugggaugacggccacggggaauccaccccuaagaaaauccauugccugcucccccaggaguuuauuggccacuucuuugauaagcaagccccuagccugggagacgcugcccugcucagauacgugaaccaggaaacgaaucgcgugcuguucgaguguaaacuuuaucgggauggcuacaucacaguugcugccucuuccgggcugcucgacuuuccccuggauggauucuuuagauucgacagcugggucuccucuuucuacauccuuagcccugugggcuccgggcagggacgccggggcagagugcgcuuucaguga

SEQ ID NO: 28421 - RNA, 1623 nt, Artificial Sequence; identical to SEQ ID NO: 27567
  derived and/or modified sequence opt5 from capsid_protein_VP1__Norovirus__ADB27914

SEQ ID NO: 28422 - RNA, 1623 nt, Artificial Sequence; identical to SEQ ID NO: 26465
  derived and/or modified sequence opt5 from capsid_protein_VP1__Norovirus__ADI45809

SEQ ID NO: 28423 - RNA, 1623 nt, Artificial Sequence; identical to SEQ ID NO: 27022
  derived and/or modified sequence opt5 from capsid_protein_VP1__Norovirus__ADI45810

SEQ ID NO: 28424 - RNA, 1623 nt, Artificial Sequence; identical to SEQ ID NO: 26466
  derived and/or modified sequence opt5 from capsid_protein_VP1__Norovirus__ADI45813

SEQ ID NO: 28425 - RNA, 1608 nt, Artificial Sequence; identical to SEQ ID NO: 26688
  derived and/or modified sequence opt5 from capsid_protein_VP1__Norovirus__ADT70684

SEQ ID NO: 28426 - RNA, 1608 nt, Artificial Sequence; identical to SEQ ID NO: 26967
  derived and/or modified sequence opt5 from capsid_protein_VP1__Norovirus__ADZ24003

SEQ ID NO: 28427 - RNA, 1623 nt, Artificial Sequence; identical to SEQ ID NO: 26686
  derived and/or modified sequence opt5 from capsid_protein_VP1__Norovirus__AFI08234

SEQ ID NO: 28428 - RNA, 1623 nt, Artificial Sequence; identical to SEQ ID NO: 26475
  derived and/or modified sequence opt5 from capsid_protein_VP1__Norovirus__AFI08237

SEQ ID NO: 28429 - RNA, 1623 nt, Artificial Sequence; identical to SEQ ID NO: 26510
  derived and/or modified sequence opt5 from capsid_protein_VP1__Norovirus__AFI08243

SEQ ID NO: 28430 - RNA, 1593 nt, Artificial Sequence; identical to SEQ ID NO: 26623
  derived and/or modified sequence opt5 from capsid_protein_VP1__Norovirus__AFJ38516

SEQ ID NO: 28431 - RNA, 1620 nt, Artificial Sequence; identical to SEQ ID NO: 26916
  derived and/or modified sequence opt5 from capsid_protein_VP1__Norovirus__AFJ38519

SEQ ID NO: 28432 - RNA, 1623 nt, Artificial Sequence; identical to SEQ ID NO: 26480
  derived and/or modified sequence opt5 from capsid_protein_VP1__Norovirus__AFW15937

SEQ ID NO: 28433 - RNA, 1623 nt, Artificial Sequence; identical to SEQ ID NO: 26479
  derived and/or modified sequence opt5 from capsid_protein_VP1__Norovirus__AFW15939

SEQ ID NO: 28434 - RNA, 1623 nt, Artificial Sequence; identical to SEQ ID NO: 27081
  derived and/or modified sequence opt5 from capsid_protein_VP1__Norovirus__AFW15942

SEQ ID NO: 28435 - RNA, 1623 nt, Artificial Sequence; identical to SEQ ID NO: 26481
  derived and/or modified sequence opt5 from capsid_protein_VP1__Norovirus__AFW15943

SEQ ID NO: 28436 - RNA, 1623 nt, Artificial Sequence; identical to SEQ ID NO: 26482
  derived and/or modified sequence opt5 from capsid_protein_VP1__Norovirus__AFW15946

SEQ ID NO: 28437 - RNA, 1647 nt, Artificial Sequence; identical to SEQ ID NO: 27065
  derived and/or modified sequence opt5 from capsid_protein_VP1__Norovirus__AFX71656

SEQ ID NO: 28438 - RNA, 1629 nt, Artificial Sequence; identical to SEQ ID NO: 27063
  derived and/or modified sequence opt5 from capsid_protein_VP1__Norovirus__AFX71659

SEQ ID NO: 28439 - RNA, 1623 nt, Artificial Sequence; identical to SEQ ID NO: 26508
  derived and/or modified sequence opt5 from capsid_protein_VP1__Norovirus__AFX81124

SEQ ID NO: 28440 - RNA, 1623 nt, Artificial Sequence; identical to SEQ ID NO: 26529
  derived and/or modified sequence opt5 from capsid_protein_VP1__Norovirus__AFX81133

SEQ ID NO: 28441 - RNA, 1623 nt, Artificial Sequence; identical to SEQ ID NO: 26677
  derived and/or modified sequence opt5 from capsid_protein_VP1__Norovirus__AFX81151

SEQ ID NO: 28442 - RNA, 1623 nt, Artificial Sequence; identical to SEQ ID NO: 26728
  derived and/or modified sequence opt5 from capsid_protein_VP1__Norovirus__AFX81160

SEQ ID NO: 28443 - RNA, 1623 nt, Artificial Sequence; identical to SEQ ID NO: 26610
  derived and/or modified sequence opt5 from capsid_protein_VP1__Norovirus__AFX81175

SEQ ID NO: 28444 - RNA, 1623 nt, Artificial Sequence; identical to SEQ ID NO: 26525
  derived and/or modified sequence opt5 from capsid_protein_VP1__Norovirus__AFX81184

SEQ ID NO: 28445 - RNA, 1623 nt, Artificial Sequence; identical to SEQ ID NO: 26562
  derived and/or modified sequence opt5 from capsid_protein_VP1__Norovirus__AFX81187

SEQ ID NO: 28446 - RNA, 1623 nt, Artificial Sequence; identical to SEQ ID NO: 26769
  derived and/or modified sequence opt5 from capsid_protein_VP1__Norovirus__AFX81217

SEQ ID NO: 28447 - RNA, 1623 nt, Artificial Sequence; identical to SEQ ID NO: 26759
  derived and/or modified sequence opt5 from capsid_protein_VP1__Norovirus__AFX81220

SEQ ID NO: 28448 - RNA, 1623 nt, Artificial Sequence; identical to SEQ ID NO: 26581
  derived and/or modified sequence opt5 from capsid_protein_VP1__Norovirus__AFX81223

SEQ ID NO: 28449 - RNA, 1623 nt, Artificial Sequence; identical to SEQ ID NO: 26518
  derived and/or modified sequence opt5 from capsid_protein_VP1__Norovirus__AFX81235

SEQ ID NO: 28450 - RNA, 1623 nt, Artificial Sequence; identical to SEQ ID NO: 26560
  derived and/or modified sequence opt5 from capsid_protein_VP1__Norovirus__AFX81259

SEQ ID NO: 28451 - RNA, 1623 nt, Artificial Sequence; identical to SEQ ID NO: 26549
  derived and/or modified sequence opt5 from capsid_protein_VP1__Norovirus__AFX81280

SEQ ID NO: 28452 - RNA, 1623 nt, Artificial Sequence; identical to SEQ ID NO: 26701
  derived and/or modified sequence opt5 from capsid_protein_VP1__Norovirus__AFX81286

SEQ ID NO: 28453 - RNA, 1623 nt, Artificial Sequence; identical to SEQ ID NO: 26557
  derived and/or modified sequence opt5 from capsid_protein_VP1__Norovirus__AFX81310

SEQ ID NO: 28454 - RNA, 1623 nt, Artificial Sequence; identical to SEQ ID NO: 26778
  derived and/or modified sequence opt5 from capsid_protein_VP1__Norovirus__AGE89469

SEQ ID NO: 28455 - RNA, 1623 nt, Artificial Sequence; identical to SEQ ID NO: 26742
  derived and/or modified sequence opt5 from capsid_protein_VP1__Norovirus__AGE89484

SEQ ID NO: 28456 - RNA, 1623 nt, Artificial Sequence; identical to SEQ ID NO: 26579
  derived and/or modified sequence opt5 from capsid_protein_VP1__Norovirus__AGE89487

SEQ ID NO: 28457 - RNA, 1623 nt, Artificial Sequence; identical to SEQ ID NO: 26615
  derived and/or modified sequence opt5 from capsid_protein_VP1__Norovirus__AGE89619

SEQ ID NO: 28458 - RNA, 1623 nt, Artificial Sequence; identical to SEQ ID NO: 26724
  derived and/or modified sequence opt5 from capsid_protein_VP1__Norovirus__AGE89670

SEQ ID NO: 28459 - RNA, 1623 nt, Artificial Sequence; identical to SEQ ID NO: 26618
  derived and/or modified sequence opt5 from capsid_protein_VP1__Norovirus__AGE99596

SEQ ID NO: 28460 - RNA, 1653 nt, Artificial Sequence; identical to SEQ ID NO: 27061
  derived and/or modified sequence opt5 from capsid_protein_VP1__Norovirus__AGE99599

SEQ ID NO: 28461 - RNA, 1620 nt, Artificial Sequence; identical to SEQ ID NO: 26865
  derived and/or modified sequence opt5 from capsid_protein_VP1__Norovirus__AGE99612

SEQ ID NO: 28462 - RNA, 1647 nt, Artificial Sequence; identical to SEQ ID NO: 27066
  derived and/or modified sequence opt5 from capsid_protein_VP1__Norovirus__AGI17609

SEQ ID NO: 28463 - RNA, 1593 nt, Artificial Sequence; identical to SEQ ID NO: 26624
  derived and/or modified sequence opt5 from capsid_protein_VP1__Norovirus__AGM33211

SEQ ID NO: 28464 - RNA, 1593 nt, Artificial Sequence; identical to SEQ ID NO: 26629
  derived and/or modified sequence opt5 from capsid_protein_VP1__Norovirus__AGM33223

SEQ ID NO: 28465 - RNA, 1623 nt, Artificial Sequence; identical to SEQ ID NO: 26659
  derived and/or modified sequence opt5 from capsid_protein_VP1__Norovirus__AGT17839

SEQ ID NO: 28466 - RNA, 1617 nt, Artificial Sequence; identical to SEQ ID NO: 26658
  derived and/or modified sequence opt5 from capsid_protein_VP1__Norovirus__AGX85910

SEQ ID NO: 28467 - RNA, 1623 nt, Artificial Sequence; identical to SEQ ID NO: 27129
  derived and/or modified sequence opt5 from capsid_protein_VP1__Norovirus__AHI59162

SEQ ID NO: 28468 - RNA, 1620 nt, Artificial Sequence; identical to SEQ ID NO: 27086
  derived and/or modified sequence opt5 from capsid_protein_VP1__Norovirus__AHI59165

SEQ ID NO: 28469 - RNA, 1623 nt, Artificial Sequence; identical to SEQ ID NO: 26675
  derived and/or modified sequence opt5 from capsid_protein_VP1__Norovirus__AHX22044

SEQ ID NO: 28470 - RNA, 1623 nt, Artificial Sequence; identical to SEQ ID NO: 26708
  derived and/or modified sequence opt5 from capsid_protein_VP1__Norovirus__AII02587

SEQ ID NO: 28471 - RNA, 1647 nt, Artificial Sequence; identical to SEQ ID NO: 26693
  derived and/or modified sequence opt5 from capsid_protein_VP1__Norovirus__AII02617

SEQ ID NO: 28472 - RNA, 1647 nt, Artificial Sequence; identical to SEQ ID NO: 26781
  derived and/or modified sequence opt5 from capsid_protein_VP1__Norovirus__AIS24556

SEQ ID NO: 28473 - RNA, 1623 nt, Artificial Sequence; identical to SEQ ID NO: 26958
  derived and/or modified sequence opt5 from capsid_protein_VP1__Norovirus__BAI49908

SEQ ID NO: 28474 - RNA, 1623 nt, Artificial Sequence; identical to SEQ ID NO: 26795
  derived and/or modified sequence opt5 from capsid_protein_VP1__Norovirus__BAI49913

SEQ ID NO: 28475 - RNA, 1623 nt, Artificial Sequence; identical to SEQ ID NO: 26802
  derived and/or modified sequence opt5 from capsid_protein_VP1__Norovirus__BAI49922

SEQ ID NO: 28476 - RNA, 1608 nt, Artificial Sequence; identical to SEQ ID NO: 26810
  derived and/or modified sequence opt5 from capsid_protein_VP1__Norovirus__BAJ25074

SEQ ID NO: 28477 - RNA, 1617 nt, Artificial Sequence; identical to SEQ ID NO: 26820
  derived and/or modified sequence opt5 from capsid_protein_VP1__Norovirus__BAP33934

SEQ ID NO: 28478 - RNA, 1623 nt, Artificial Sequence
  derived and/or modified sequence opt5 from major_capsid_protein__Norovirus__ABQ63283
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuguuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaagauguguucaccguguccugcagaguccugacacggccuagcccggacuuugauuucaucuuucucgugcccccuaccguugagucucgcacgaaacccuucuccgugccuauucugaccgucgaagagaugacaaauagcagauuucccaucccgcuugagaagcuguucaccgggccuucuuccacaauugugguucagccccagaacggacgguguaccacggacggcgugcuccuggggacaacccaacugagcccugucaauaucugcacauuccgcggagaugugacccauaucgccggcacccaggaauacacaaugaaccucgccucucagaauuggaacaauuaugaccccacggaggaaauuccugcuccccugggcaccccggauuuugucgggaaaauccagggagugcuuacacaaaccacaagacgggacggcuccacccgcgggcacaaggcgacgguuagcacaggauccgugaacuucaccccuaagcugggccggauucaguuuucuaccgacacaagcaaugauuucgagaccgggcaguccacaagauuuacgcccgucggagugguucaagacggcagcaccacacaucagaacgaaccccagcagugggugcucccugauuacucuggccgcgacucccacaauguccaccuggccccggcuguggcccccagcuucccuggggagcaacuucuguuuuucagaucuaccaugcccggauguagcggcuacccuaacaugaaucucgauugccugcugccccaggagugggugcagcauuuuuaucaggaagccgcuccugcccaauccgacguugcgcuccugcgguucgucaaccccgauacagggagagugcuuuuugaguguaaacugcacaagucuggauacgugaccgucgcucauacgggccagcacgaccucgugaucccgccuaauggguauuuccgcuuugauagcuggguuaaccaguucuacacccuggcccccaugggcaacggaacaggccggagacgcgcccuuuga

SEQ ID NO: 28479 - RNA, 1623 nt, Artificial Sequence
  derived and/or modified sequence opt5 from major_capsid_protein__Norovirus__ABV55634
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaaauggaauaaguaugacccuaccgaagagauucccgccccucuugggacacccgauuucgugggaaagauccagggcguccugacgcagaccacaaaaggggacggaucuacccggggccacaaggcuacaauuuacaccggguccgccccguuuacgccuaaacucggaagcgugcaguucuccacagacaccgaaaacgauuuugagacccaucaaaauacaaaguucacccccguuggcgugacacaggacggcucuacgacccaccgcaacgaaccccagcaauggguccugccuagcuacuccgggagaaaugugcacaacguucaucuugccccggcuguggcccccacauuuccuggagagcagcuccuguucuuucggagcaccaugcccggcuguucuggguauccuaauauggaucuggacugccugcucccccaggaguggguccagcacuucuaccaagaagcggcuccugcccaguccgauguggcccugcuucgcuuugugaaccccgacacaggaagaguucuguucgaguguaaacuccauaagagcggcuaugucaccguggcucacacggggcagcacgaucuggugaucccgccuaauggcuacuuucgguucgacucuugggucaaccaguucuauacccuugcccccaugggaaacggcacagggagacgccgggcucuguga

SEQ ID NO: 28480 - RNA, 1623 nt, Artificial Sequence
  derived and/or modified sequence opt5 from major_capsid_protein__Norovirus__ACV41093
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggucuaacuacgauccuacagaggaaauucccgccccucugggcacgcccgacuuuguggggaagauccagggaaugcuuacccagacaaccggccgcgacggguccacaagaggacacaaagcuaccguccugacgggcagcgccgauuucgccccgaagcucgggcgggugcaauuugcuacagacaccgauaaugacuucgaguccggagaaaacaccaaguuuacaccuguuggcgugauucaggauggcucuaccacacaucgcaaugagccccagcaauggguccugcccaacuacagcgggagaacgggacacaaugugcaccuugccccugcgguugcuccgaccuaucccggcgaacagcuccuguucuuucgguccacaaugccuggguguagcggauaccccaacauggaccuggauugccugcucccucaggagugggugagacauuucuaucaggaggccgcccccgcucaaucugacgucgcccugcuucgcuuugugaauccugauaccggccgggugcuguucgaauguaaacuccacaagcccggguacguuacagucgcucauaccggccagcacgaccuggugaucccgccuaacggauauuuuagauucgauuccugggugaaccaguuuuacacgcuugcccccaugggcaaugggaccggacgccggagagcgcuguga

SEQ ID NO: 28481 - RNA, 1635 nt, Artificial Sequence
  derived and/or modified sequence opt5 from major_capsid_protein__Norovirus__ACV41096
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaacgggugcucaaccugacagagcuugacggaucucccuucauggcuuucgccgcuccugcccccgccggcuuuccugaucugggguccugcgacuggcacaucgagaugagcaaaauccccaauuccucuacccagaacaauccgauugucgugaacagcgucaagccuaauucccagcaguucgugccccaucucagcucuaucacacuggaugacaacguuuccagcggaggcgauuacauuggcaccauccaauggacgucucccccuagcgacuccgggggagcuaauacaaacuuuuggaagauuccggauuauggcucuagccuggcggaagccucccagcucgcucccgccguguacccucccggguucaaugaggucaucguguauuuuauggccagcaucccuggacccaaccagucuggcuccccuaaucugguucccugucuucugccgcaggaauacauuacccacuucaucagcgagcaagcuccuauucagggggaggccgcgcuccugcacuacguggaccccgauaccaaccgcaaucuuggcgaauuuaaacuguauccuggaggcuaccucacaugcguccccaacucuuccagcaccgggccgcagcagcugccucuggacggaguguucguguuugcuuccuggguuucuagauucuaucaacucaagcccgucggcacagccgggccugcccggggacgccugggcgugagacgguga

SEQ ID NO: 28482 - RNA, 1743 nt, Artificial Sequence
  derived and/or modified sequence opt5 from major_capsid_protein__Norovirus__ACV88130
augaagauggccagcaacgacgcuaccgcccccucccaggauggcgcggcuaaucuggugccugaaucucaacacgaaguccucgcccuggagccgguugccggggcugcccuugcugcccccguggcgggacaguucaacgccaucgacccuuggauuaaacagaauuuugugcaggcucccgccggcgaguucacagucagcccuagaaacgcucccggggaaauccugauggaucucgaacugggaccugagcuuuccccguuucuggcccaucucgcgcaaauguacaaugccuaugcuggcgggauggaggugcagauuauccuggccggaaacgcuuucacggccggcaagauuaucguuugcgccgugcccccuaauuuucccccugaccggcugucugcuagccaggcgaccaacuucccccacgucaucauggaugugcgcacacucgaaccgguuauucugccucuucccgacgugagagccggcuuuuuccauuacaaucagcugcgggagccucgcaugagacucauggcucugcuuuauacaccccugcgggccaacgggaccggagaugacgccuuuaccgucuccugucgcgugcucacaagacccaugcaagauuucgaauuuauguuccuggugccuccgaccgucgagucucggguuacgcccuuuagcgugccuaccuaccccguggucgagaugacaaauucccgcuggccugcuagaaucagcggcaugcacgugaacgccaaucagacccuggcgguucaguuccagaacgggcggugcacacucgacggacaacugaugggcaccacgcagcuuugugcugccgaugugugccgcaugagagggcgguauacaucuacccgcgccgaccuggcuggagucgaucauacagaccagggccccucccucggcgccgggccgagcaaugacccugugucuguucccgaagcuagaucccaaacccggaccagcgugucugcccaccuccagcuugaggaacugaacggacagccuuacgaggucuauggcgaacagcccgcgccucucgggacacccgauuucuguugcagacugaugggagagcuggugcgccucccguccacgagcccugccgcucaaucccgguuuagagacgccuucuuugauaccuacggcgcucuguucgcccccgcggucgggucuacaaccuuuacagugaacaauagcuccaccagcgacuucgccaacggacagcccuuugaguuccuuccuauuggcguugaaaucggcaauucugcucaguacgaugaguuugcccugccguccuauaacggggcuauuggagaaaaucgccaccucgcccccguggccgcuccuggcuuccccggggagaacaucgucuuuuucagcucuaaucugccugugugggacagcacguccgcgcagaacaaucggagaauuucuugucuucugcccaacgaauuuguucaacauuucuacgaucuccaggccccuagccaguccgacguggcucugcugcgcuauguccaccccgagagcggacgggugcuguucgagugcaaacuguacagagauggcuuucuuacagugaauggggccucucuggccgaguucccgguuaacggcuauuuucgcuucgacuccugggucaaucaguuuuucacccucagcccugugggaaccggcucugggcgguccggaagaagccgcaacgcucaauga

SEQ ID NO: 28483 - RNA, 1623 nt, Artificial Sequence; identical to SEQ ID NO: 27629
  derived and/or modified sequence opt5 from major_capsid_protein__Norovirus__ACW19927

SEQ ID NO: 28484 - RNA, 1623 nt, Artificial Sequence
  derived and/or modified sequence opt5 from major_capsid_protein__Norovirus__ACX31885
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucaccguuccuauccugacaguggaggaaaugaccaacucuagauuucccauuccgcuugagcggcuguacacagggccuuccagcgccuucgucgugcagccccagaauggacgcuguaccacggauggcguucuccuggggacaacccaacugucugccgugaacaucugcacauucagaggagacgucacccauaucgcuggcucccggaauuauaccaugaaccucgcgagccagaauuggaacaauuacgauccuacagaggaaauucccgccccucugggcacgcccgacuuuguggggaagauccagggaaugcuuacccagacaacccgcucugacggcuccacaagagggcacaaagcuaccguccugacgggaagcgccgauuucgccccgaagcucggccgggugcaauuugcuacagacaccgauaacgacuucgaguccgggcagaauaccaaguuuacaccuguuggagugauucaggauggcucuaccacacaucgcaacgaaccccaacaguggguccugcccaauuacagcggcagaacggggcacaacgugcaccuugccccugcgguugcuccgaccuaucccggagagcagcuccuguucuuucgguccacaaugccuggcuguagcggguaccccaauauggaccuggauugccugcucccucaggaaugggugcaacauuucuaucaggaggccgcccccgcucagucugacgucgcccugcuuagauuugugaacccugauaccggacgcgugcuguucgaguguaaacuccacaaguccggcuacguuacagucgcucauaccgggcagcacgaccuggugauucccccgaacggcuauuuucgguucgauagcugggugaaucaauuuuacacgcuugccccuaugggaaacggcaccgggagacgccgggcgcuguga

SEQ ID NO: 28485 - RNA, 1623 nt, Artificial Sequence
  derived and/or modified sequence opt5 from major_capsid_protein__Norovirus__ACX31887
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuaauuacagcgggagaaacguuccgaaugugcaccuugcccccgcugucgccccuaccuuucccggagagcagcuccuguucuuucgguccacaaugccuggcuguagcggguaucccaacauggaucuggacugccugcucccucaggagugggugcagcauuucuaccaagaagcggcucccgcccagucugauguggcccugcuucgcuuuguuaacccggacaccggaagaguccuguucgaguguaaacuccacaaguccggcuaugugacaguggcucauaccgggcagcacgaucuggucaucccuagcaauggcuacuuucgguucgacucuugggugaaccaguucuauacgcuugcccccaugggaaauggcaccgggagacgccgggcucuguga

SEQ ID NO: 28486 - RNA, 1623 nt, Artificial Sequence
  derived and/or modified sequence opt5 from major_capsid_protein__Norovirus__ACX31891
augaagauggccagcuccgacgcuucucccagcgauggcuccgccgcgaaccuggugccugaggucaauaacgaaguuauggcucucgagccgguggugggggccgccaucgcugcccccgucgcuggacagcaaaauaucaucgacccuuggauuagaaacaauuucgugcaggcccccggcggggaauuuaccguuucuccucggaacgcgcccggagagauccuguggagcgccccucuuggcccggaucugaaucccuaccucucccaccugucucgcauguauaacggguacgcuggaggcuucgaagugcaggucauucuugccggcaaugcuuuuacagccgggaaagugaucuucgcggccguuccucccaacuuuccuacggagggacugagccccucccaggugaccauguucccgcauaucauugucgacgugagacaacucgagccugugcugaucccccugccugauguccggaauaacuuuuaucacuacaaucagacaaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucaccguuccuauccugacaguggaggaaaugaccaacagcagauuucccauuccgcuugagcggcuguacacagggccuucuuccgccuucgucgugcagccccagaauggacgcuguaccacggauggcguucuccuggggacaacccaacugagcgccgugaacaucugcacauucagaggagacgucacccauaucaccggcucucggaauuauacaaugaaccucgcuucccagaauuggaacaauuacgauccuacggaggaaauucccgcgccucugggcacccccgacuuuguggggaagauccagggaaugcuuacacagaccacacgcggcgacgggagcaccagaggacacaaagccacggucuacacaggcuccgcugauuucgccccgaagcuggggcgggugcaauuugccaccgacaccgauaacgacuucgagucuaaucagaacacaaaguuuaccccuguuggagugauucaggauggcaauacaacgcaucaaaacgaaccccagcaguggguccuccccggcuauagcgggcgcgacggacacaaugugcaccuggcuccugccguugcgccgaccuaccccggcgagcagcuucuguucuuuagauccacaaugccuggguguagcggauaucccaacaugaaucucgauugccugcugccucaagaaugggugcagcauuucuaccaggaggcugcccccgcccagucugaggucgcucuccugcgguuugugaacccugacaccggcagagugcuuuucgaauguaaacugcacaaguccggguauguuacagucgcccauaccggccaacacgaucucgugauucccccgaacggauacuuucgcuucgacagcugggugaaucaguuuuauacgcuggcuccuaugggcaacggggccggacggagacgcgcgcuuuga

SEQ ID NO: 28487 - RNA, 1623 nt, Artificial Sequence
  derived and/or modified sequence opt5 from major_capsid_protein__Norovirus__ACZ37232
augaagauggccagcaacgacgcugcccccuccaaugauggcgcggcugggcuggugccugagaucaacaaugaagucaugccgcucgagcccguugccggagccucucuggcuaccccuguggugggccagcaaaacauuaucgaccccuggauuagaaauaacuucguccaggccccugcuggggaauuuacagugagccccagaaauuccccuggagagauccuucuggaucucgaacugggcccggagcuuaaccccuaccuggcccaccucgcgcgcauguauaaugggcaugccggaggcauggagguucagauugugcuggcuggcaacgccuucacggcugggaaaaucaucuuugccgcgauuccucccggauucccuuacgaaaaucugucucccagccagaucaccaugugcccgcacgucauuaucgacgugagacaacucgagccuguucugcuucccaugccugauauucggaacaacuuuuuccauuauaaucagggcaaugaccccaagcugcgccucguggccaugcuguacacaccccuuagagcuaacaacuccggggaugacgucuuuaccgugucuugucgggugcugacaaaaccuagcccggauuucgaauuuaccuuccucguucccccuacagucgaguccaagaccaaacaguuuacgcugcccauccugaagauuagcgagaugaccaauucucgcuucccugugcccguggaaaugauguauacagccagaaacgagaaucaggucgugcaaccgcagaacggacggguuacccucgacggcgaacugcuugggacaaccccucugcucgcugugaauaucugcaaguuuaaaggagaggucaucgccaagaacggcgaugugcgcuccuacagaauggacauggaaauuacgaauacagauggcacccccaucgacccuacagaggacacccccgggccuauuggaagccccgauuuccagggcauccuguucgggguugccucucagcggaacaccaaugagccgaacccugcuacacgcgcgcacgaagccaauauuaacacgggaggcgaccaauaugcucccaaacuugcccaggugaaguuuuucuccgagagccaggauuuugaaguccaucaacccaccguguucacaccugucgggguggccggagacaccucucacccguuuagacaguggguucugccccgguacggcggccaccucacaaauaacacccaucuggcuccugccguggcgccccuguucccuggggagcagauccucuuuuuccgcucccagauccccagcuccggaggccacgaacugggguacauggauugucuugucccucaagagugggugcagcauuuuuaucaggaggcugccacggcccagucugaaguugcucugauuagauucaucaaucccgacacaggacgggugcucuuugaggccaaacugcacaagcaaggcuucauuaccgucgcucacaccggggauaacccgaucgugaugccucccaacggcuacuuuagauucgaagccugggugaaucaguucuauagccuugcgccuguuggaacaggcaacgggcgccggcggauucaguga

SEQ ID NO: 28488 - RNA, 1623 nt, Artificial Sequence; identical to SEQ ID NO: 26482
  derived and/or modified sequence opt5 from major_capsid_protein__Norovirus__ADD10375

SEQ ID NO: 28489 - RNA, 1623 nt, Artificial Sequence
  derived and/or modified sequence opt5 from major_capsid_protein__Norovirus__ADO85552
augaagauggccagcuccgacgcuaaccccucugauggcagcaccgccaaucuggugccugaggucaacaaugaaguuauggcgcucgagccgguggugggggcugccuccgccgcucccgucgccggacagcaaaacgugaucgacccuuggauuagaaauaacuucguucaggcucccggcggggaauuuacagagucuccuacgaaugcccccggagaaauccuguggagcgcgccucuuggcccggaucugaaccccuaccucucccaccuggcccggauguauaauggguacgcuggaggcuucgaggugcaggucauucuugccggcaacgcuuuuaccgccgggaaaaucauuuucgcggccgugccucccaauuuuccuacagagggacugucucccagccagguuaccauguucccgcauaucaucguggacguccgccaacucgaaccugugcugauuccccugccugaugugagaaacaauuuuuaucacuacaaccaguccaaugaccccacaaucaagcucauugcuaugcuguauacaccccuucgggccaacaacgcuggcgaugacgucuucaccguuagcugccgcgugcugaccagaccuucuccggauuuugacuucaucuuucucgugcccgccacggucgagucccggaccaaaccuuucagcgugcccguucugacaguggaagagaugaccaauucucgcuuuccuauuccccuugagaagcuguucacagggccguccagcgccuucgucgugcagccucagaacggaagauguaccacggauggcguucuccuggggacaacccaacugucucccgugaauaucugcacauuucggggagacgucacccauauuccuggcucccgcaacuacaccaugaaucucgcuagccagaacuggaacuccuaugaucccacagaagagaucccugcgcccgugggcacgccggacuucgucgggaaaauccagggagugcugacccagacaaccagaacaaauggcucuacccgggggcacaaggccacgguuuacacaggaagcgcugacuuuuccccuaaacuuggccgcgugcaauucgccaccgauaccgacaaugauuuugaaacaaaccagaauaccaaguucacacccgucggggugauucaggacggaagcacgacccccagaaacgagccucaacaguggguucugccgucuuacuccggccggaauauccauaacgugcaccucgcccccgcugucgccccuacauuucccggcgaacagcugcuuuucuuucgcagcaccaugccuggguguucuggauaucccaauauggaucuggacugccuccugccucaggagugggugcaauacuucuaucaggaggcggcucccgcccagagcgauguggcccugcucagauuuguuaacccggacacaggccggguccuguucgaauguaaacuucacaaguccggguacgugaccguggcucauacgggacagcacgaucuggucauuccucccaacggcuauuuuagauucgacucuugggugaaucaauucuacacccucgccccuauggggaacggcacaggacgccggagagcucuguga

SEQ ID NO: 28490 - RNA, 1623 nt, Artificial Sequence
  derived and/or modified sequence opt5 from major_capsid_protein__Norovirus__ADQ43779
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggcccugccuuccuacagcgggagaaacgugcagaauguucaccuugcuccggccguggcgcccaccuuuccuggagagcagcuccuguucuuucggucuacaaugcccggcuguuccggguauccuaacauggaucuggacugccugcucccccaggaguggguccaacauuucuaccaggaagcugccccugcccagagcgauguggcucugcuucgcuuugugaaucccgacaccggaagaguucuguucgaguguaaacuccacaagucuggcuaugucacaguggcccauaccgggcagcacgaucuggugaucccgccuaacggcuacuuucgguucgacagcugggucaaccaauucuauacgcuugcucccaugggaaauggcaccgggagacgccgggcccuguga

SEQ ID NO: 28491 - RNA, 1623 nt, Artificial Sequence; identical to SEQ ID NO: 26522
  derived and/or modified sequence opt5 from major_capsid_protein__Norovirus__ADQ43781

SEQ ID NO: 28492 - RNA, 1623 nt, Artificial Sequence; identical to SEQ ID NO: 27022
  derived and/or modified sequence opt5 from major_capsid_protein__Norovirus__ADQ43783

SEQ ID NO: 28493 - RNA, 1623 nt, Artificial Sequence; identical to SEQ ID NO: 27022
  derived and/or modified sequence opt5 from major_capsid_protein__Norovirus__ADV37805

SEQ ID NO: 28494 - RNA, 1623 nt, Artificial Sequence; identical to SEQ ID NO: 27022
  derived and/or modified sequence opt5 from major_capsid_protein__Norovirus__ADV37807

SEQ ID NO: 28495 - RNA, 1623 nt, Artificial Sequence; identical to SEQ ID NO: 27022
  derived and/or modified sequence opt5 from major_capsid_protein__Norovirus__ADV37809

SEQ ID NO: 28496 - RNA, 1623 nt, Artificial Sequence
  derived and/or modified sequence opt5 from major_capsid_protein__Norovirus__ADV37813
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugaucucgagaccaaccagaauacaaaauuuacccccgucggggugauccaggacggauccacaacgccucggaacgaaccgcaacaguggguucugcccagcuacucuggccgcaauauucauaacgugcaccuugccccugccgucgcucccaccuucccuggcgagcagcugcucuuuuucagauccacaaugcccggguguagcggauauccuaauauggaucuggacugccugcucccccaggaaugggugcaauacuuuuaucaggaggccgcgccggcucagucugauguggcccugcuucgguucguuaacccugacaccggcagaguccuguuugaguguaagcuccacaaaagcggguacgugacaguggcccauaccggacagcacgaucuggucauucccccuaacggcuauuuccgcuuugacuccugggugaaucaauucuacacgcuugcucccauggggaacggcaccggacggagacgcgcccuguga

SEQ ID NO: 28497 - RNA, 1623 nt, Artificial Sequence
  derived and/or modified sequence opt5 from major_capsid_protein__Norovirus__ADV37917
augaagauggccagcuccgacaccaaaacaucugauggcagcacggcuaaccuggugcccgaggucaauaacgaaguuauggcccucgagccuguggugggggcggcuaucgccgccccggucgcuggacagcaaaaugugauugaccccuggaucagaaacaauuucguucaggccccuggcggggaauuuaccgugucuccccggaacgcuccuggagagauucugugguccgcgccccuuggcccugaucugaauccguaccucagccaccuggcccgcauguauaacggguacgccggaggcuucgaaguccaggugauccuugcuggcaaugccuuuacagcugggaagauuaucuucgccgcgguucccccuaacuuucccaccgagggacuguccccuucucaggugacaauguucccccauaucauugucgacgugagacaacucgagccggugcugaucccucugcccgauguccggaauaacuuuuaucacuacaaucagagcaacgacccuaccauuaaacucaucgccaugcuguauacaccccuucgcgcuaauaacgccggcgaugacguuuucaccguguccugcagagugcugacgcggcccagcccugauuuugacuucauuuuucucgucccgcccaccguggaaucucgcacaaagccuuucuccguucccauccugaccguggaggaaaugacaaacagcagauuuccuauuccccuugagaaacuguucaccgggccgucuuccgcuuucgucgugcagccucagaauggacgguguacgaucgauggcguucuccuggggacaacccaacugagccccgugaacaucugcacauuucgcggagacgucacccauauuaccggcucuagaaauuacacaaugaaccucgccacgcagaauuggaacuccuaugauccuaccgaggaaauccccgccccucugggcacacccgacuucguggggaagauucagggaguccuuacccagacaacccgggcugacggcagcacgcgcgggcacaaggcgacaguguacaccggauccgccgauuuugcuccgaaacugggcagaguucaauucgccaccgacacagauaaugacuuugaugccaaccagaauaccaaguucacaccugugggggucauccaggacggaaacacggcucaucggaaugagccccaacagugggugcuccccucuuacagcggccgcaacucccacaauguucaccuggccccugcgguggcuccgaccuuucccggcgaacagcuucuguucuuuagaagcacaaugccuggguguucuggauaucccaacauggaucucgacugccugcugccucaggaguggguccaauacuucuaucaggaagccgcccccgcucaguccgauguggcccuccugcgguuugugaauccugacaccggcagaguucuuuucgaguguaaacugcauaagagcggguacgucacaguggcucacaccggacagcaugaucucgugauucccccgaacggcuauuuucgcuucgacucuugggucaaccaauucuacacgcuggccccuauggggaauggcaccggacggagacgcgcgcuuuga

SEQ ID NO: 28498 - RNA, 1623 nt, Artificial Sequence
  derived and/or modified sequence opt5 from major_capsid_protein__Norovirus__ADV37919
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaucgauggcguucuccuggggaccacgcaacugagcccugugaauaucugcacauuucgcggagacgucacccauauuacaggcucuagaaacuacaccaugaaucucgccacccagaacuggaacuccuaugaucccacagaggaaaucccugcuccccugggcacgccggacuucguggggaaaauucagggaguccuuacccagacaacccgggcggacggcagcacacgcgggcacaaggccaccguguacacgggauccgcugauuuugccccuaagcugggcagaguucaauucgccacagacaccgauaaugacuuugaugcuaaucagaacaccaaauucacacccgugggggucauccaggacggaaauaccgcccaucggaacgagccccaacagugggugcucccuucuuacagcggccgcaauucccacaacguucaccuggcgccggcuguggcccccacauuuccuggcgaacagcuucuguucuuuagaagcacgaugcccggguguucuggauauccuaauauggaucucgacugccugcugccccaggaguggguccaauacuucuaucaggaagccgcuccugcccaguccgauguggcucuccugcgguuugugaaccccgacaccggcagaguucuuuucgaguguaagcugcauaaaagcggguacgucacaguggcccacaccggacagcaugaucucgugauuccgccuaacggcuauuuucgcuucgacucuugggucaaucaauucuacacacuggcgcccauggggaacggcaccggacggagacgcgcccuuuga

SEQ ID NO: 28499 - RNA, 1608 nt, Artificial Sequence
  derived and/or modified sequence opt5 from major_capsid_protein__Norovirus__AEI83469
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgagaaucacguuuggaacaugcaagugaccaauauuaacgggacaccuuucgaucccaccgaagacgucccugcuccccugggaaccccggauuucagcggcaaacucuuuggggugcugucucagcgcgaccaugacaaugccuguagaucccacgaugccgucaucgcuacaaacagcgcgaaguucacgccuaaacuuggagccauucagaucggcaccugggaggaggacgaugugcacaucaaucagcccacaaaguuuacccccguugggcuguucgaauccgagggauuuaaccaguggacacucccuaauuauucuggcgcucugacccuuaacaugggccuggccccgcccguggccccuacguuccccggggaacaaauucucuuuuuccggagccauaucucccugaagggaggcgucgcugacccugugauugauugccugcucccccaggaguggauccagcaccuguaccaggaaagcgccccuucucaaacagacguugcgcuuauucgcuuuaccaaccccgauaccgggagagugcuguucgaggcuaaacuccaucgguccggauacaucacagucgccaauaccggcagcagaccgaucguggugccugccaacggguauuuucgcuucgacucuuggguuaaucaguuuuacagccuggcucccaugggcacaggaaacggccggagacgcguccaguga

SEQ ID NO: 28500 - RNA, 1644 nt, Artificial Sequence
  derived and/or modified sequence opt5 from major_capsid_protein__Norovirus__AEP04093
augaagauggccagcaacgacgcugcccccuccaccgauggcucugcggggcuggugccugaggucaauaacgaaacaauggcucucgagccgguugugggagcuccccuggccgccccuguggccggccagcacaauaucauugaccccuggaucaaaaugaacuucguccaagcuccuaauggggaauuuacggugagccccagaaacgccccuggagagauucuucuggaucucgaacugggcccggaccuuaaucccuaccugucccaucucgcgcggauguauaacggguacgccggaggcauggagguucaggugguccuggcuggcaaugccuucaccgcugggaagaucauuuuugccgcggugccucccaacuucccugccgagaaucugucugcugcccagguuacaaugugcccccacgugaucgucgaugugcgccagcucgaaccggugaugcugccuaugcccgacaucagaaacaaacuuuuucauuauaaucaagucgaugacccuaagcugcggcuccuggcuuaccuuuauacaccccugcgcgccaacaaugccggagaugacguuuucaccgugagcuguagagugcucacccggcccacaccugauuuugaguucauguuucuggucccgcccaccguggaauccaaaacgaagccuuucucucugcccagccucacccuggacgagcuuuccaacagccgcuuuccugcucccauuguucagcuguacacaaacccgcacgauaaucucgugguccagccucagaacggcagaugcaccaucgacgggcugcuucaaggaacaacccagcuggugucuuguaauguuugcuccuuccggggcacgauuggggacggacagcccgcgagccauucugaggaagagaucaugccuauggccuuuaacauucagcgcgaacucaugcuggagaaucuggauggcucccccuaugacccuacagaugacauccccgcugugcucggcagcccggauuuccaaggggucauuuucggaauccugucucagagaaacggcgacgggcagacccgggcccacgaagccaagguggauacacgcgcugccagauuugcgccuaaacuuggauucgucguggcuaccguugaguccaccgacuuucacgccaaucaacccagccgguucacacccgugggccucgggggagauggcaaccaggacuuugcccaguggaaucucccuacguacggcggggcucugaccaacaauacaaaccuugccccgcccgucaugccuguguaccccggagagcagcugcuguucuuucgcucccaacugccuucuagcggcgggguugugggaggcuggcuggauugucuccugccccaggaauggguccagcauuucuuucaggaguccgcuaccagccaaucugacguggcccuugugagauauaucaauccuacaaccgggcggguucuguucgaagcgaagcuccacaaacagggcuuucugacggucgccgcuuccggaagcuacccccugguggugccggccgacggcuauuucagauuugagucuugggucaaccaguucuacacacuugcuccuauggggaauggaagcggccgccggagaacccgcuga

SEQ ID NO: 28501 - RNA, 1620 nt, Artificial Sequence
  derived and/or modified sequence opt5 from major_capsid_protein__Norovirus__AEQ77282
augaugauggccagcaaggacgcucccuccaacauggauggcaccucuggggccggacagcuggugccugaggucaaugcggcugaaccgcucccccuggagccuguugugggcgccgccacagcugccgcuacggccgggcaagugaaccuuaucgaccccuggauuaugaauaacuucguccaggcgccugaaggagaguuuaccaucagccccaauaacacaccuggcgauauucuguucgaccuccaccuggggccgcaucuuaaucccuuucugcagcaccucucccagauguacaacggaugggugggcaauaugagaguucgggugaugcuggccggcaacgcuuucaccgccgggaaaaucauuaucugcugugucccucccggauuugcuucucaaaauaucagcauuggccaggccacaauguucccucaugugaucgcggauguucgcgugcuggaacccauugagaucccgcucgacgaugucagaaacgugcuguuucacaccaaugagaaccggccuacaaugcgccuucugugcaugcucuauacgccccugagagccgggggagcuuccucuggcaccgacccuuucgugauugccgggcggguccuuaccugucccagccccgauuuuaauuuccuguuucucguuccuccguccguggaacagaagacacgccagcugaccgugcccaacaucccucugaacaaucucgcuaacagcagaguccccgccaugauuaauaaaaugacagugucuaccgaccaaaaccagguugugcaguuccagaauggacggugcacgcuggagggccaacuucugggcacaaccccugucuccgccagccagguggcucgcaucagagggaagguuuucucuacagcguccggaaaaggccucaaccugaccgaacuugaugggacccccuaccaugccuucgagagcccggcuccucugggauuccccgacaucggcgccugugauuggcacgugucuacauuuaaggucgaccagaaucucuccggggacccuaugagccggcuggaugugaagcaaaacgcccccuucgcuccucaccugggauccauugaguuuacgucugaccaggaucccaccggcgaccagcucggcacacuggccugggucagcccguccaccagcggggcgcgcguggauccuuggaaaauccccucuuauggauccacaguuaccgaaagcacgcaucuugcucccccuauuuucccgcccggcuuuggggaggccaucguguacuucaugucugacuuuccuauugucagcggaaauacagcccaggugcccugcacccugccucaagaauuuguuucccacuuuguggagcagcaggcucccgucagaggcgaagccgcucuccugcauuauguggauccugacacccaccggaaccuuggggaguucaagcuguaccccgauggcuuuaucacaugugugccgaauaccggaggcgggccucagaaccuccccacaaauggaguuuucgucuuuucuagcugggugucccgcuauuaccaacugaaaccugugggcacggccgggcccgcgagacggcugggagucagacgcguguga

SEQ ID NO: 28502 - RNA, 1608 nt, Artificial Sequence
  derived and/or modified sequence opt5 from major_capsid_protein__Norovirus__AFA55174
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagaaugaacuucgugcaagcccccaauggggaauuuacggucagcccucggaacucccccggagaggugcuucugaaucucgaacugggcccugagcuuaacccguuccuggcgcaccucucucgcauguacaauggguaugccggaggcguugaggugcagguccugcuggcuggcaacgccuuuaccgcugggaagcucguguucgccgcgauucccccucauuuuccccuggaaaaucuuagcccuggacagaucacaauguucccccacguuauuaucgaugugagaacccuggagccgguccuccugccucuucccgacgugcggaacaacuuuuuccauuacaaucagcaaccugaaccccgcaugagacugguggccaugcucuauacaccccugcgguccaacggcucuggggaugacgucuuuaccguuagcugccgcgugcugacaagaccuuccccggauuucgacuuuaauuaccucgugcccccuaccgucgagagcaagacgaaacccuucacccugccuauccuuacaauuggagagcugucuaacucccgguuucccgugccgaucgaugaacucuauaccagcccuaaugagggcguugugguccagccccagaacgggcgcucuacacuggacggagaacuucugggcaccacgcagcucgugccuuccaauauuugugcucugagaggccggaucaacgcccaaguucccgaugaccaccaucaguggaaucuucaggugacaaacgcuaaugggaccagcuucgauccuacagaggacguccccgccccgcucggaaccccugacuuccuggccaacauuuacggcgugaccucucagcgcaaucccgauaacacaugcagagcucacgacgggguccuugcgacguggucccccaaguuuaccccuaaacugggaagcgugguucucggcacaugggaagaguccgaucuggaccuuaaucaaccgacccgguucacacccguggggcuguaugauaccggacacuuugaccaguggguccucccuaacuacucuggccgccugacgcugaauaugaaccucgcccccagcguggcuccucuguuccccggcgagcagauccuguuuuucagaucccauauuccucugaaagggggaacaagcaacggcgccaucgauugucuccugccccaagaauggauccagcacuuuuaccaggagucugccccguccccuaccgacguugcucugauucgguauaccaaucccgauacagggagagugcuuuucgaagccaagcuccaucgccagggauuuaucaccgucgcgaacagcggcucucggccuauuguggugcccccgaauggguacuucagauuugacagcuggguuaaccaauucuauucccuggcuccuaugggcacaggaaauggccgccggagaguccaguga

SEQ ID NO: 28503 - RNA, 1629 nt, Artificial Sequence
  derived and/or modified sequence opt5 from major_capsid_protein__Norovirus__AFC89656
augaagauggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaaaauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaaaccuuucacacugcccauucugaccaucuccgaacucacaaacagccgguuuccgaucucuauugagcagcuguacaccgcuccuaacgagaauaacgugguccagugucagaauggccgcugcacgcuugacggggaacugcaaggaacaacccagcuccuguccagcgccguguguucuuauagaggccggacaguugccaacuccggggauaauugggaccagaacgugcuucagcugaccuaccccagcggagcuuccuacgauccuaccgacgagguccccgcgccucucggcacacaagacuucucuggcauccuguauggggugcugacgcaggauaauguucgcgaaaacaccggagaggccaagaaugcuaaaggcguguacauuagcacaaccuccgggaaguuuacacccaagaucggaagcauuggccuccauucuaucaccgaagacgucagaccgaaccagcaaucccgguucacgccugugggggucgcccagaaugagaacacacccuuccagcagugggugcugccccacuaugccggagcucuugcccugaauaccaaccucgcgccugcuguugccccgaccuuucccggcgagcaacugcuuuucuuucgcagcagagugccuugcguccagggccugcaggggcaggaugccuucaucgacugucuccugccccaagaaugggugaaucauuuuuaccaggaggcugccccuucucaggcugauguugcccugauucgguaugugaaccccgacacaggaagaacccucuucgaagcgaaacugcaccgcagcggcuuuaucacagucucccacacgggggccuacccucuuguggugcccccgaacggacauuuccgguuugauucuuggguuaaucaguucuauagccuggcuccuaugggcaccgggaacggcagacgccggguccaauga

SEQ ID NO: 28504 - RNA, 1617 nt, Artificial Sequence
  derived and/or modified sequence opt5 from major_capsid_protein__Norovirus__AFC89659
augaugauggccagcaaggacgcucccuccaacauggauggcaccucuggggccggacagcuggugccugaggucaauacagcggaaccgcucccccuggagccuguugugggcgcugccacggccgcugccaccgcugggcaagugaaccuuaucgaccccuggauuaugaauaacuucguccaggccccugaaggagaguuuacaaucagccccaauaacaccccuggcgauauucuguucgaccucagacuggggccgcaccuuaaucccuuucugcuccaucugucccagauguacaacggaugggugggcaauaugcggauccgcguuaugcuggcgggcaacgccuucucugcugggaaaauuaucaucugcugugugccucccggauuugaaagccagaauauuuccaucggccaagccacaauguucccucacgucauugcugaugugagaguucucgagcccaucgagauuccgcuggacgaugugcggaacguccuuuaucauaccaaugaaaaccgcccuacaaugagacugcucugcaugcuguacacgccccuucgggccgggggagcgucuagcggcaccgacccuuuugugaucgccgggcgcgugcugaccugucccgcucccgauuucaauuuucucuuccuggucccuccguccguugagcagaagacaagacagcugaccauucccaacaucccucucaacaaucuggccaacagccgggugcccgcuaugaucaauaaaauggccgugucugccgaccagaaccaagucgugcaguuucagaauggacgcugcacacuugaaggccagcugcucggcaccacgccuguuuccgcuaaccaaguggcgcggauuagagggaaggucuucagcacaaauucuggaaccggccugaaccuuacagagaccgaugggacccccuaucacgccuuugaguccccggcuccucugggauuccccgacaucggcgauugugacuggcauguguacgccuucaaaguuaaucagaacacaggggacccuauguaucgccucgauauuacgcagggaaauagcuuugcuccccaccugggcucuaucgaguucaccuccgaccaacacccuagcggcgaucagcuggggacacucaccuggauuucuccccugaacaaugccuccagaguggacccguggaagaucccuagcuacggauccacacuuaccgaaagcacgaaccuggccccucccaucuuucccccgggcuucggggaagcgauugucuauuuuaugucugauuuccccaucguguccggaaauacaacccagauuccuugcacccucccccaggaguuuaucagcucuuucgucgaacaacaggcuccuauucggggcgaggccgcccugcuucauuacguggaccccgauacacaccgcaaccugggggaguuuaagcucuacccugacggcuucaucaccuguguucccaacacaggaggcgggccgcagaaucugccuagcaacggaguguuuaucuucuccucuugggucagcagauauuaccagcugaaacccgugggcacggcugggccugcccggagacucggaguucgccggauuuga

SEQ ID NO: 28505 - RNA, 1647 nt, Artificial Sequence
  derived and/or modified sequence opt5 from major_capsid_protein__Norovirus__AFC89662
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccacagacaaucuguccgccgcucagaucaccaugugcccucaugugauugucgaugugcgccaacuggagcccguuaaccucccgaugccugacgugagaaauaacuucuuucacuauaaccagggcucugauagccggcugcgccuuaucgccaugcuguacacaccccucagagccaauaacuccggggacgaugucuucaccgugucuugucgggugcugacacgcccuagccccgacuuuuccuucaauuuucuuguucccccuaccgucgaaagcaagacgaaaccguucacccugcccauucucacaaucucugagauguccaacagcagauuuccugugcccauugauucucugcauaccuccccuacagaaaauaucgugguccagugccagaacggacgggugacccuggacggcgagcucauggggacgacacaacugcuucccagccagaucugugcuuuccgcggaguucugaccagaucuacaucccgggcgagcgaucaggccgacaccgcuaccccgcgccucuucaauuauuacuggcacauucagcuggacaaccuuaauggcacaccuuaugaucccgccgaggacaucccuggcccccuggggacgccugauuuuagaggaaagauuuucggcguggccucccaacggaaccccgacucuaccacacgcgcucaugaagccaaagucgauaccacagcggggagauuuaccccgaagcucggaagccuggagaucuccacggaaagcggcgacuucgaucagaaucagccuacacgguuuacccccguggggauuggaguugacaacgaggcugauuuccaacaguggucucugcccgacuacuccggccaguuuacccacaauaugaaccucgccccugccguggcuccgaauuuccccggcgaacagcugcuguuuuucagaagccaacuuccuucuagcgggggacgcuccaacggcauccucgauugccuggucccccaggagugggugcagcacuuuuaccaggagucugccccugcucaaacacaggucgcccuugugcgguauguuaaccccgacaccgggagagugcuguucgaagcgaagcuccauaaacugggauuuaugacaaucgccaagaauggcgacagcccuauuacggugcccccgaacggguacuuccgcuucgaguccugggucaauccuuuuuauacccuggcucccaugggcacaggaaacggccggagacgcauccaguga

SEQ ID NO: 28506 - RNA, 1620 nt, Artificial Sequence
  derived and/or modified sequence opt5 from major_capsid_protein__Norovirus__AFC89665
augaagauggccagcaacgacgcugcccccuccaaugauggcgcgaccgggcuggugccugagaucaacacagaaacgcucccgcuggagcccgucgcuggagccgccauugcugccccuguuaccggccagaauaacaucauugaccccuggaucagaaauaacuucgugcaagcuccuaauggggaauuuacagugucuccccggaacagcccuggagagauucuuaugaaucuggaacucggcccggaucugaaccccuaccuugcccaccugucccgcauguauaauggguacgcgggaggcgucgaggugcagguucuccuggccggcaacgcuuucaccgccgggaaaauccuguuugcugccgugccucccaauuucccugucgacaugcucucucccgcgcagaucacaaugcugccgcaucuuauuguggauguuagaacccuggagccuaucaugauuccccucccugacgugcggaacgucuuuuaucacuucaauaaccagcccgcuccccgcaugagacugguggccaugcuuuacacaccucugcggagcaacggauccggcgaugacguguuuaccgucucuugccgcguucucacgagaccgacccccgauuucgaauuuacauaucuggugccucccagcguggaguccaagaccaaaccuuucacacugcccauccucaccauuggggaacugacgaauagccgguuuccggccccuaucgaccaacuuuacacaucucccaacgcugaugucgugguucagccucagaauggacgcuguacccuggacggcgagcuccaggggacaacccaacugcuuaccacagccauuugcuccuauagaggaaugacgagcaaccccaccucugauuacugggacgaccaucugcuccaccuggugcauccuaauggcgccacauacgaucccaccgaggacgucccggcuccuuucggcacacaggauuuucgggggauccuguauggaaugcucacccagaacccccgcacguccggcgacgaagcggccaauagccacgggaucuacauuucuuccacaagcgagaaguucacccccaaacugggaaccaucggccuucaccaggugcaaggggauauugcuuccaaccagcagucuaaguucacaccuguuggaaucgccgugaauggcaacaccccguuuagacaaugggaacugcccaauuauagcggcgcccucacacugaacacgaaucuugcuccugccgucgggcccaacuucccuggagagcagauucuguuuuuccgguccaaugugcccagcguccagggcgggcagccuaucgaaaucgacugucucauuccccaagagugggugucucauuuuuaccaggaguccgcgccgagccagucugauguugcucuggugcgcuaugucaacccugacaccggaagaacaaucuucgaagccaagcugcaccggcagggcuuuauuaccaucgccgcuacagggagcaaccccgugguugugccucccaauggcuacuucagauuugauuccugggucaaccaauucuaugcccucgcuccgaugggaaccggcaaugggcgccggagagugcaguga

SEQ ID NO: 28507 - RNA, 1623 nt, Artificial Sequence; identical to SEQ ID NO: 26932
  derived and/or modified sequence opt5 from major_capsid_protein__Norovirus__AFC89667

SEQ ID NO: 28508 - RNA, 1626 nt, Artificial Sequence
  derived and/or modified sequence opt5 from major_capsid_protein__Norovirus__AFD62272
augagaaugagcgacggcgccgcucccaaggccaacggguccgaggcgucuggacaggaucuggugccuaccgcugucgaacaagccguuccgauccagcccguggccggcgcugcccucgcugccccugcggccgggcagauuaaucagaucgaccccuggauuuuccaaaacuuugugcagugcccucugggagaguucagcaucagcccccggaauacaccuggcgaaauucuuuuugaucuggcucucgggccgggacugaaccccuaccuugcccaccugucugcuauguauacgggcugggucggcaauauggaggugcagcucguucuggccgggaacgcguucaccgccggaaaaguggucguggcucugguuccucccuacuuuccuaagggcagccucacaaccgcccagaucacauguuucccccaugugaugugcgacguccgcacccuggaaccgauccaacuuccucugcucgaugugagacgggugcuguggcacgcuacacaggaccaggaggaguccaugcgccuugucuguaugcuguauacgccccucagaaccaauucuccuggggaugaauccuuuguuguguccggacggcugcugagcaaacccgccgccgacuucaacuuuguguaccucacacccccuauugagcgcaccaucuauagaauggucgaucugccggugcuucagccccggcugugcacccaugcucgcuggccugcgcccguuuacggccuccugguggacccuucucuucccuccaauccgcaauggcagaacgggagaguccacguggauggaacacugcucggcaccacgccuguuagcggcucuuggguguccuguuucgccgcugaagccgccuaugaguuucagagcgggacaggacaagucgcuaccuucacaaugauugagcaggacggcucugccuacgugcccggggaucgggcggcuccucugggauaccccgacuauuccggccagcuggaaaucgagguccagaccgaaaccacaaaggccggggacaaacucaaggugacgaccuuugagaugauucugggaccuacaaccaauguugaucaagcccccuaccagggccgcgcuuaugccagccuuacagcugccgcgucccuggaccucguggauggcagaguccgggccgugccgcgcucuaucuacagcuuccaggacguucugccugaauauaacgaugggcuucuggugccccucgcucccccucugggaccguuccugcccggcgagguccuccugagauuucggaccuacaugagacagcuugacacggccgaugcugccgcgcaaccuauugacugcgcccugccccaggaguucguguccugguuugcuagcaauucuuucacagugcaguccgaugcccuccugguucgcuaucggaacacccugaccgggcagcuucucuuugaagcuaagcuguacagcgagggauacaucgccgucucuuauagcggcuccgggccucugacauuccccgccgacggcuuuuucgaaguggugucuugggucccuagacucuuucaacuggcuagcgugggaucccuugcgaccggccgcacacugaaacaguga

SEQ ID NO: 28509 - RNA, 1620 nt, Artificial Sequence
  derived and/or modified sequence opt5 from major_capsid_protein__Norovirus__AFJ04707
augaagauggccagcaacgacgcuucccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucaccguucccauccugacaguggaggaaaugagcaauucuagauuuccuauuccccuugagaagcuguacaccgggccguccagcgccuucgucgugcagccucagaacggacgguguacaaccgauggcguucuccuggggacgacacaacugucugccgugaauaucugcaccuuccgcggagacaucacacauauugcuggcucccacgauuauaccaugaaccucgcgagccagaauugguccaacuacgaccccaccgaggaaaucccugcuccccugggcacaccugacuuugucgggaaaauucagggaaugcuuacgcagaccacaagagaggauggcucuacccgggcccauaaggccacagugagcaccggguccguccacuucacgcccaagcugggaagcgugcaauacacaaccgacaccaauaacgauuuucagacaggccagaauaccaaauucacaccgguuggggugauccaagacggaggcaaccaccagaaugaaccucagcaguggguccuccccaacuauucuggccgcacggggcauaaugugcaccuggcccccgcuguugccccuaccuuuccgggagagcaacuucuguucuuuagauccacaaugcccggcuguagcggguacccuaacaugaaucucgauugccugcugccccaggaaugggugcagcauuucuaucaggaggcggcuccugcccaaucugacgucgcccuccugcgguuugugaaccccgauaccggacgcgugcuuuucgaguguaagcugcacaaaagcggcuacguuacagucgcucacaccgggccucaugaccucgugauucccccgaacggcuauuuuagauucgauuccugggugaaucaguuuuacacgcuggccccuaugggaaacggcgcugggcggagacgcgcccuuuga

SEQ ID NO: 28510 - RNA, 1623 nt, Artificial Sequence
  derived and/or modified sequence opt5 from major_capsid_protein__Norovirus__AFJ04708
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaaaccggccagaauacaaaguucacgcccguuggcgugguccaggaugggaacggagcucaccaaaaugagccccagcagugggugcucccuuccuacagcggcagaaccgggcauaacguucaccuggccccggccguggcucccacauuuccuggagaacagcuucuguucuuucgguccaccaugcccggcuguucuggguacccuaacaugaaucucgacugccugcugccccaagaguggguccagcauuucuaucaggaggccgcgccugcucagagcgauguggcccuccugcgcuuugugaaccccgacacaggcagaguucuuuucgaauguaaacugcacaaguccggauacgucaccguggcccacacgggccaacaugaucucgugaucccgccuaauggguauuuucgguucgacagcugggucaaccaguucuacacccuggcucccaugggaaauggcacagggagacgccgggcccuuuga

SEQ ID NO: 28511 - RNA, 1623 nt, Artificial Sequence
  derived and/or modified sequence opt5 from major_capsid_protein__Norovirus__AFJ04709
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcucuacaacgcaccgcaacgaaccccagcaaugggugcugccuagcuacuccgggagaaauguucacaacgugcaucuugccccggcugucgcccccaccuuuccuggagagcagcuccuguucuuucggagcacaaugcccggcuguucuggguauccuaauauggaucuggacugccugcucccccaggagugggugcagcacuucuaccaagaagcggcuccugcccaguccgauguggcccugcuucgcuuuguuaaccccgacaccggaagaguccuguucgaguguaaacuccauaagagcggcuaugugacaguggcucacaccgggcagcacgaucuggucaucccgccuaacggcuacuuucgguucgacucuugggugaaucaguucuauacgcuugcccccaugggaaacggcaccgggggaagacgcgcucuguga

SEQ ID NO: 28512 - RNA, 1623 nt, Artificial Sequence
  derived and/or modified sequence opt5 from major_capsid_protein__Norovirus__AFP89593
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacagcuacgcugggggauucgaaguccaggugauccuugccggcaaugcuuuuacggccggcaaaauuaucuucgcggccguuccucccaacuuuccuaccgaggggcugucccccucucaggugacaauguucccgcauaucauugucgacgugagacaacucgagccugugcugaucccccugccugauguccggaauaacuuuuaucacuacaaucagagcaacgaccccaccauuaagcucaucgcuaugcuguauacaccccuucgcgccaacaaugcuggagaagauguuuucaccguguccugcagagugcugacacggccuagcccggacuuugauuucauuuuucucgugcccccuaccgucgagucucgcacgaaacccuucaccguuccuauccugacaguggaagagaugaccaacuccagauuucccauuccgcuugagaagcuguucacaggcccuagcggggccuucgucgugcagccccagaauggacgguguaccacggacggcguucuccuggggacaacccaacugucuccugugaacaucugcacauuucgcggagaugucacccauaucgccggcacccacaauuacacaaugaaccucgcuucccagaauuggaacaauuaugaccccacggaagagauuccugcgccccugggcaccccggauuucguggggagaauccagggaaugcuuacacagaccacacggggcgacgggagcacccgcggacauaaagccacggucucuacaggcgacgugcacuuuaccccuaagcugggguccauucaauucaacaccgauacaaauaacgacuuugaaaccggacagaauacaaaguucacgcccguuggcgugauccaggauggcaacgggacccaccaaaaugagccccagcaguggguccucccuagcuacuccggaagaacaggccauaacgugcaccuggcuccggccguugcccccaccuuuccuggggaacagcuucuguucuuucggucuacaaugcccggauguagcggcuacccuaacaugaaucucgacugccugcugccccaagagugggugcagcauuucuaucaggaggcugccccugcgcaguccgaugucgcucuccugcgcuuugugaaccccgacaccgggagagugcuuuucgaauguaaacugcacaagagcggcuacguuacggucgcccacaccggacaacaugaucucgugauuccgccuaauggcuauuuucgguucgacucuugggugaaccaguucuacacacuggcccccauggggaauggaaccggcagacgccggguccuuuga

SEQ ID NO: 28513 - RNA, 1623 nt, Artificial Sequence
  derived and/or modified sequence opt5 from major_capsid_protein__Norovirus__AFU55686
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaagauguuuucaccgugagcugcagagugcugacacggccuuccccggacuuugauuucauuuuucucgugcccccuaccgucgagagccgcacgaaacccuucaccguuccuauccugacaguggaagagaugaccaacucuagauuucccauuccgcuugagaagcuguucacagggccuuccggagccuucgucgugcagccccagaauggccgguguaccacggacgggguucuccugggaacaacccaacugagcccugugaacaucugcacauuucgcggcgaugucacccauaucgccggcacccacaauuacacaaugaaccucgcuucucagaauuggaacaauuaugaccccacggaagagauuccugcgccccuggggaccccggauuucgugggaagaauccagggcaugcuuacacagaccacacgcggggacggauccacccggggccauaaagccacggucagcacaggggacgugcacuuuaccccuaagcugggaucuauucaauucaacaccgauacaaauaacgacuuugaagcuggccagaauaccaaguucacacccgauggcguugugcaggacgggaacggaacgcaccaaaaugagccccagcaguggguccucccuuccuacagcggcagaaccgggcauaacgugcaccuggccccggccaucgcucccacauuuccuggagaacagcuucuguucuuucgguccaccaugcccggcuguucuggguacccuaacaugaaucucgauugccugcugccccaagaguggguucagcauuucuaucaggaggccgcgccugcucagagcgacguggcccuccugcgcuuugucaaccccgauacaggcagagugcuuuucgaauguaaacugcacaaguccggauacgugaccguugcccacacgggccaacaugaccucgucauuccgccuaauggguauuuucgguucgauagcugggugaaccaguucuacacccuggcucccaugggaaauggcacagggagacgccgggcccuuuga

SEQ ID NO: 28514 - RNA, 1623 nt, Artificial Sequence
  derived and/or modified sequence opt5 from major_capsid_protein__Norovirus__AFU55689
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcgccccggacuucguggggaaaauccagggaguccuuacccaaacaaccagaggcgacgggucuacacggggacacaaggcuaccguguccacgggcagcguucauuuuacaccuaagcugggguccgugcaguucucuaccgauaccagcaaugaccucgagacaggacagaacacccgcuuuacacccgucggcgugguucaagauggcuccacgacccaccagaaugaaccccagcagugggugcugccuaacuacagcgggagagacucucacaauguccaucuugccccggccguggcucccacauucccuggagagcaacugcucuuuuuccgguccaccaugcccggcuguagcggguacccuaacaugaaucuggauugccugcucccccaggaaugggugcagcacuuuuaucaggagucugccccugcgcaaagcgacguugcucugcuucgcuucgucaaccccgauacaggaagagugcuguuugaguguaaacuccauaaguccggcuacgugaccgucgcccacacggggcagcacgaccuggugauuccgccuaacggcuauuuccgguuugauucuuggguuaaucaguucuacacccuugcccccaugggaaacggcgcugggagacgccgggcccuguga

SEQ ID NO: 28515 - RNA, 1623 nt, Artificial Sequence
  derived and/or modified sequence opt5 from major_capsid_protein__Norovirus__AFU55692
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucgccggcacccagaacuacacaaugaaucucgcuagccagaacuggaauaacuaugaucccacggaggaaauuccugcgccccugggcaccccggacuucguggggaaaauccagggaguccuuacacaaaccacaagacgggacggcucuacccgcgggcacaaggccacgguguccacaggaagcguucauuuuaccccuaagcugggcuccgugcaguucucuaccgauacaagcaaugacuuugagaccgggcagaacacaagauucacgcccgucggagugguucaagauggcuccaccacacaccagaaugaaccccagcagugggugcucccugacuacagcggccgggauucucacaacguccaucuggcuccggccguggcccccaccuuuccuggggagcaacuucuguucuuucgcuccacaaugcccggauguagcggcuacccuaauaugaaccucgacugccugcugccccaggaaugggugcagcacuucuaucaggagucugcuccugcccaaagcgauguugcgcuccugagauuugucaaucccgacaccgggcgggugcuuuucgaguguaaacugcauaagccgggauacgugacggucgcucacaccggccagcacgaucucgugauuccucccaacggguauuuuagauucgacuccuggguuaaccaguucuacacacuggccccuaugggcaauggagccggccgccggagagcucuuuga

SEQ ID NO: 28516 - RNA, 1623 nt, Artificial Sequence; identical to SEQ ID NO: 26945
  derived and/or modified sequence opt5 from major_capsid_protein__Norovirus__AFU55695

SEQ ID NO: 28517 - RNA, 1623 nt, Artificial Sequence
  derived and/or modified sequence opt5 from major_capsid_protein__Norovirus__AFU55698
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauuccuacgcugggggauucgaaguccaggugauccuugccggcaacgcuuuuacggccggcaaaauuaucuucgcggccguuccucccaauuuuccuaccgaggggcugucucccagccaggugacaauguucccgcauaucauugucgacgugagacaacucgagccugugcugaucccccugccugauguccggaacaauuuuuaucacuacaaccaguccaaugaccccaccauuaagcucaucgcuaugcuguauacaccccuuggagccaacaacgcuggcgaugacguuuucaccgugagcugccgcgugcugacaagaccuucuccggauuuugacuucauuuuucucgugcccccuaccgucgaaucccggacgaaacccuucagcguuccuauccugaccguggaggaaaugacaaauucucgcuuucccauuccgcuugagaagcuguucaccgggccuuccagcgccuucgucgugcagccccagaacggaagauguacaaccgauggcguucuccuggggacgacacaacugucuccugugaauaucugcaccuuucggggagacgucacacauaucgccggcacccaggaguacaccaugaaccucgcuucccagaauuggaacaauuaugaucccacagaagagauuccugcgccccugggcacgccggacuucguggggaaaauccagggaguccuuacccaaacaacccgcagagacggcagcacacgggggcacaaggccaccguguccacgggaucuguucauuuuacaccuaagcugggccgcauucaguucagcaccgauaccuccaacgacuuugaaacagggcagaauaccagauucacacccgugggagucgugcaagauggcagcacgacccaccagaacgagccccagcaguggguucucccuaauuacucuggccgggacucccacaacgugcaucuggcuccggccgucgcccccagcuuuccuggggaacaacuucuguucuuucgcucuacaaugcccggauguagcggcuacccuaauaugaaccucgauugccugcugccccaggagugggugcagcacuucuaucaggaggcugccccugcgcaauccgacguggcucuccugagauuuguuaaucccgauaccgggcggguccuuuucgaauguaaacugcauaagucuggauacgugacaguggcccacaccggccagcacgaccucgucaucccgccuaacggguauuuuagauucgauagcugggugaaccaguucuacacgcuggcccccaugggcaauggaaccggccgccggagagcucuuuga

SEQ ID NO: 28518 - RNA, 1623 nt, Artificial Sequence; identical to SEQ ID NO: 27495
  derived and/or modified sequence opt5 from major_capsid_protein__Norovirus__AFU55701

SEQ ID NO: 28519 - RNA, 1623 nt, Artificial Sequence; identical to SEQ ID NO: 27584
  derived and/or modified sequence opt5 from major_capsid_protein__Norovirus__AFU55704

SEQ ID NO: 28520 - RNA, 1623 nt, Artificial Sequence
  derived and/or modified sequence opt5 from major_capsid_protein__Norovirus__AFU55707
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacagaaggcgacggguccacccggggacacaaggcuacaguguacaccggcagcgccccguuuacgccuaagcucggguccguucaguucucuacagacaccgagaacgauuuugaaacccaucaaaauacaaaauucacccccgugggagucauucaggacggcagcacaacgcaccgcaacgagccccagcaaugggugcugccuuccuacagcggcagaaauguucacaacgugcaucuugccccggcugucgcccccaccuuuccuggggagcagcuccuguucuuucggucuacaaugcccggauguuccggcuauccuaauauggaucuggacugccugcucccccaggaaugggugcagcacuucuaccaagaggcggcuccugcccagagcgauguggcccugcuucgcuuuguuaaccccgacaccgggagaguccuguucgaauguaagcuccauaaaucuggauaugugacaguggcucacaccggccagcacgaucuggucaucccgccuaacggguacuuucgguucgacagcugggugaaucaguucuauacgcuugcccccaugggcaacggaaccggcagacgccgggcucuguga

SEQ ID NO: 28521 - RNA, 1623 nt, Artificial Sequence; identical to SEQ ID NO: 26991
  derived and/or modified sequence opt5 from major_capsid_protein__Norovirus__AFU55710

SEQ ID NO: 28522 - RNA, 1623 nt, Artificial Sequence
  derived and/or modified sequence opt5 from major_capsid_protein__Norovirus__AFU55713
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugaccccacaauuaagcucaucgcuaugcuguauacaccccuucgcgccaacaacgcuggcgaugacguuuucaccgugagcugcagagugcugacccggccuuccccggauuuugacuucauuuuucucgugcccccuacggucgaaagccgcaccaaacccuucucuguuccuauccugacaguggaggaaaugaccaauuccagauuucccauuccgcuugagaagcuguucacagggccuagcucugccuucgucgugcagccccagaacggacgguguaccacggauggcguucuccuggggacaacccaacuguccccugugaauaucugcacauuucgcggagacgucacccauaucaccggcagcagaaacuacacaaugaaucucgccacgcagaacuggaacucuuaugaucccaccgaggaaauuccugcuccccugggcacaccggacuucguggggaaaauccagggaguccuuacccagacaacccgggcggacggcuccacgcgcgggcacaaggccacaguguacaccggaagcgcugauuuugccccuaagcugggcagaguucaauucgccaccgacacagauaaugacuuugaugcuaaucagaacaccaaauucacacccgugggggucauucaggacggagauacggcccaucggaaugagccccaacagugggugcucccuuccuacucuggccgcaacagccacaauguucaccuggcgccggcuguggcccccaccuuuccuggcgaacagcuucuguucuuuagauccacaaugcccggguguagcggauauccuaacauggaccucgauugccugcugccccaggaguggguccaauacuucuaucaggaagccgcuccugcccagucugacguggcucuccugcgguuugugaaucccgauaccggcagaguucuuuucgaguguaagcugcauaaauccggguacgucacaguggcccacaccggacagcaugaccucgugaucccgccuaacggcuauuuucgcuucgacagcugggucaaccaauucuacacgcuggcgcccauggggaauggcaccggacggagacgcgcccuuuga

SEQ ID NO: 28523 - RNA, 1623 nt, Artificial Sequence
  derived and/or modified sequence opt5 from major_capsid_protein__Norovirus__AFU55716
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaguccugacgcagaccacaaagggcgacggguccacccggggacacaaggcuacaguguacaccggcagcgccccguuuacgccuaaacucggguccguucaguucucuacagacaccgaaaacgauuuugagacccaucaaaauacaaaguucacccccgugggagucauucaggacggcggcacaacgcaccgcaacgaaccccagcaaugggugcugccuagcuacuccgggagaaauguucagaacgugcaccuugccccggcugucgcccccaccuuuccuggagagcagcuccuguucuuucggagcacaaugcccggcuguucuggguauccuaauauggaucuggacugccugcucccccaggagugggugcaacauuucuaccaggaagcggcuccugcccaguccgauguggcccugcuucgcuuuguuaaccccgacaccggaagaguccuguucgaguguaaacuccacaagagcggcuaugugacaguggcucauaccgggcagcacgaucugaucauuccgccuaacggcuacuuucgguucgacucuugggucaaucaauucuauacgcuugcccccaugggaaacggcaccgggagacgccgggcucuguga

SEQ ID NO: 28524 - RNA, 1623 nt, Artificial Sequence; identical to SEQ ID NO: 27567
  derived and/or modified sequence opt5 from major_capsid_protein__Norovirus__AFU55719

SEQ ID NO: 28525 - RNA, 1623 nt, Artificial Sequence; identical to SEQ ID NO: 26482
  derived and/or modified sequence opt5 from major_capsid_protein__Norovirus__AFU55722

SEQ ID NO: 28526 - RNA, 1623 nt, Artificial Sequence
  derived and/or modified sequence opt5 from major_capsid_protein__Norovirus__AFU55725
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucuccgcgguuccucccaauuuuccuaccgagggacugucucccagccaggugacaauguucccgcauaucauugucgacgugagacaacucgagccugugcugaucccccugccugauguccggaacaauuuuuaucacuacaaccaguccaaugaccccaccauuaagcucaucgccaugcuguauacaccccuucgcgcuaacaacgccggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaauucuagauuucccauuccgcuugagaagcuguucaccgggccuuccagcacauucgucgugcagccccagaacggacgguguaccacggauggcguucuccuggggacaacccaacugucuccugugaauaucugcacauuucgcggagacgucacccauaucaccggcuccagaaacuacacaaugaaucucgcuagccagaacuggaacuccuaugaucccacggaggaaauuccugcuccccugggcaccccggacuucguggggaaaauccagggaguccuuacacagaccacacggaccgacggcucuacgcgcgggcacaaggccacaguguacaccggaagcgccgaguuuuccccuaagcugggcagaguucaauucgcgaccgauacagacaaugauuuugacgccaaucagaacaccaaauucacacccgugggggucauucaggauggaggcacgacccaucggaaugaaccccaacagugggugcucccuagcuacucuggccgcaacacacacaauguucaccuggcuccggccguggcccccaccuuuccuggggagcagcuucuguucuuuagauccacaaugcccggauguagcggcuauccuaacauggaccucgauugccugcugccccaggaauggguccaacauuucuaccaggaggcugccccugcgcagucugacguggcucuccugcgguuugugaaucccgauaccgggagaguucuuuucgaguguaagcugcacaaaagcggauaugucacgguggcccauaccggccagcacgaccucgugaucccgccuaacggguacuuucgcuucgauuccugggucaaccaauucuauacacuggcccccaugggcaauggaaccggccggagacgcgcucuuuga

SEQ ID NO: 28527 - RNA, 1623 nt, Artificial Sequence
  derived and/or modified sequence opt5 from major_capsid_protein__Norovirus__AFU55728
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucucacaacuacaccaugaaucucgccucccagaacuggaauagcuaugauccuaccgaggaaauccccgcuccgcugggcacaccugacuucgucgggaaaauucagggagugcuuacgcagaccacaagaaccaacggcuccacacgggggcauaaggcgaccguuuacacgggaucugccgacuuuagccccaagcugggccgcgugcaauucgcuacagauaccaauaacgacuuugagaccaaucagaacacaaaauucacccccgucggggugauccaggauggauccacaacgccuagaaaugaaccgcaacaguggguucuccccagcuacucuggccggaacacccacaaugugcaccuggccccugccgucgcucccacauuuccuggcgagcagcuucuguucuuucgcuccaccaugcccggguguagcggauauccuaacauggaccucgauugccugcugccccaggaaugggugcaauacuucuaucaggaggccgcgccggcucagucugacguggcccuccugagauuuguuaacccugauacaggccggguccuuuucgaguguaagcugcauaaaagcggguacgugaccguggcccacacgggacagcaugaccucgucauucccccuaauggcuauuuuagauucgauuccugggugaaccaauucuacacccuggcucccauggggaauggcacaggacgccggagagcccuuuga

SEQ ID NO: 28528 - RNA, 1623 nt, Artificial Sequence
  derived and/or modified sequence opt5 from major_capsid_protein__Norovirus__AFU55731
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucucacaacuacaccaugaaucucgccucccagaacuggaauagcuaugauccuaccgaggaaguccccgcuccgcugggcacaccugacuucguggggaaaauccagggaguucuuacgcagaccacaagaaccaacggcuccacacgggggcauaaggcgaccguguacacgggaucugccgacuuuagccccaagcugggccgcguccaauucgcuacagauaccaauaacgacuuugagaccaaucagaacacaaaauucacccccguggggguuauucaggauggauccacaacgccuagaaaugaaccgcaacagugggugcuccccagcuacucuggccggaacacccacaauguccaccuggccccugccguggcucccacauuuccuggcgagcagcuucuguucuuucgcuccaccaugcccggguguagcggauauccuaacauggaccucgauugccugcugccccaggaaugggugcaauacuucuaucaggaggccgcgccggcucagucugacguugcccuccugagauuugucaacccugauacaggccgggugcuuuucgaguguaagcugcauaaaagcggguacgugaccgucgcccacacgggacagcaugaccucgugauucccccuaauggcuauuuuagauucgauuccuggguuaaccaauucuacacccuggcucccauggggaauggcacaggacgccggagagcccuuuga

SEQ ID NO: 28529 - RNA, 1623 nt, Artificial Sequence; identical to SEQ ID NO: 26522
  derived and/or modified sequence opt5 from major_capsid_protein__Norovirus__AFU55734

SEQ ID NO: 28530 - RNA, 1623 nt, Artificial Sequence; identical to SEQ ID NO: 26522
  derived and/or modified sequence opt5 from major_capsid_protein__Norovirus__AFU55737

SEQ ID NO: 28531 - RNA, 1623 nt, Artificial Sequence
  derived and/or modified sequence opt5 from major_capsid_protein__Norovirus__AFU92659
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccuggcccgcauguauaauggguacgcuggaggcuucgaaguccaggugauccuugccggcaacgcuuuuaccgccgggaaaauuaucuucgcggccguuccucccaauuuuccuacagagggacugagccccucccaggugaccauguucccgcauaucauugucgacgugagacaacucgagccugugcugaucccccugccugauguccggaacaauuuuuaucacuacaaccagucuaaugacagcacaauuaagcucauccccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaauagcagauuucccauuccgcuugagaagcuguucacagggccuucuuccgcuuucgucgugcagccccagaacggacgguguaccacggauggcguucuccuggggacaacccaacugagcccugugaauaucugcacauuucgcggagacgucacccauaucgccggcacccagucuuacacaaugaaccucgccucccagaauuggaacaauuaugaucccacggaggaaauuccugcuccccugggcaccccggacuucguggggaaaauccagggaguccuuacacaaaccacaagaggcgacgggagcacccggggacacaaggcgacgguguccacaggcucuguucauuuuaccccuaagcuggggagcgugcaguucuccaccgauacaagcaacgacuuugagaccggacagaauacacgcuucacgcccgucggcgugguucaagauggcucuaccacacaccagaacgaaccccagcagugggugcucccuaauuacuccgggagagacagccacaacguccaucuggccccggcuguggcccccaccuuuccuggagagcaacuucuguucuuucggucuacaaugcccggcuguagcggguacccuaauaugaaccucgauugccugcugccccaggaaugggugcagcacuucuaucaggaguccgccccugcucaaucugacguugcccuccugcgcuuugucaaucccgauaccggaagagugcuuuucgaguguaaacugcauaagagcggcuacgugacggucgcgcacaccgggcagcacgaccucgugauuccgccuaacggcuauuuucgguucgauuccuggguuaaccaguucuacacacuggcucccaugggaaauggcgccgggagacgccgggcccuuuga

SEQ ID NO: 28532 - RNA, 1623 nt, Artificial Sequence
  derived and/or modified sequence opt5 from major_capsid_protein__Norovirus__AFU92660
augaagauggccagcaacgacgcucaccccuccgauggcucuaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacagugagcccucggaaugcccccggagagauucugugguccgcgccucuuggcccggaucugaaccccuaccucucucaucuggcccgcauguauaauggguacgcuggaggcuucgaaguccagacgauccuugccggcaacgcuuuuaccgccgggaaaauuaucuucgcggccgugccucccaauuuuccuacagagggacugagccccucccagguuaccauguucccgcacaucauuguggacgucagacaacucgagccugugcugaucccccugccugaugugcggaacaauuuuuaucauuacaaccagucuaaugaccccacaauuaagcucaucgcuaugcuguauacaccccuucgcgccaacaacgcuggcgaugacgucuucaccguuagcugcagagugcugacccggccuuccccggauuuugacuucauuuuucucgugcccccuacggucgaaagccgcaccaaacccuucacagugccuauccugaccguugaggaaaugacaaauucuagauuucccauuccgcuugagaagcuguucaccgggccuuccagcgccuucgugguccagccccagaacggacgguguacgacagauggcgugcuccuggggaccacacaacugucuccuguuaauaucugcaccuuucgcggagacgugacccacaucgccggcacacauaacuacacgaugaaucucgcuucccagaacuggaauaacuaugaucccaccgaggaaauuccugcgccccugggcacaccggacuucgucgggagaauccagggaaugcuuacccagacaacccggggcgacgggagcacgcgcggacacaaagccacagugucuaccggcgauguccacuuuaccccuaagcugggguccauucaauucaauacagacaccaacaaugauuuugagacaggacagaacacgaaguucacccccgugggcguugugcaggacggcaaugggacacaucaaaacgaaccccagcaguggguccucccuagcuacuccggaagaaccggccacaaugugcaucuggcuccggccguugcccccacauuuccuggggagcagcuucuguucuuucggucuaccaugcccggauguagcggcuacccuaacaugaaccucgauugccugcugccccaagaaugggugcagcacuucuaucaggaggcugccccugcgcaguccgacgucgcucuccugcgcuuugugaaucccgauacggggagagugcuuuucgaguguaaacugcacaagagcggcuacguuaccgucgcccauacaggacaacacgaccucgugaucccgccuaacggcuauuuucgguucgauucuugggugaaucaguucuacacccuggcccccauggggaacggaacaggcagacgccgggcucuuuga

SEQ ID NO: 28533 - RNA, 1623 nt, Artificial Sequence
  derived and/or modified sequence opt5 from major_capsid_protein__Norovirus__AFU92661
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugccacgcgccucuuggcccggaucugaaccccuaccucucccaucuggcccgcauguauaauggguacgcuggaggcuucgaaguccaggugauccuugccggcaacgcuuuuaccgccgggaaaauuaucuucgcggccguuccucccaauuuuccuacagagggacugucucccagccaggugaccauguucccgcacaucauugucgacgugagacaacucgagccugugcugaucccccugccugauguccggaacaauuuuuaucauuacaaccaguccaaugaccccacaauuaagcucaucgcuaugcuguauacaccccuucgcgccaacaacgcuggcgaugacguuuucaccgugucuuguagagugcugacccggccuagcccggauuuugacuucauuuuucucgugcccccuacggucgaaucccgcaccaaacccuucagcguuccuauccugacaguggaggaaaugaccaauucuagauuucccauuccgcuugagaagcuguucacagggccuuccagcgccuucgucgugcagccccagaacggacggugcaccacggauggcguucuccuggggacaacccaacugucuccugugaauaucuguacauuucgcggagacgucacccacaucgccggcacccagaacuacacaaugaaucucgcuucccagaacuggaauaacuaugaucccacggaggaaauuccugcgccccugggcaccccggacuucguggggagaauccagggaguccuuacacaaaccacacggcgcgacggcagcaccagagggcauaaagccacgcugucuacaggauccgugcacuuuaccccuaagcucggcagcguucaguucuccaccgauacaucuaaugacuuugagaccgggcagaacacacgguucacgcccgugggagucgugcaagauggcagcaccacacaccagaaugaaccccagcaguggguucugccuaacuacuccggccgcgacagccauaaugugcaccuugcuccggccgucgcccccaccuuuccuggggagcaacuccuguucuuuagaucuacaaugcccggaugcuccggcuacccuaacaugaaucuggauugucugcucccccaggaaugggugcagcauuucuaucaggagagcgcuccugcccaaucugacguggcgcugcuucgguuuguuaaccccgauaccgggagaguccuguucgagugcaagcuccacaaaagcggauacgugacgguggcucacaccggccagcaugaccuggucauuccgccuaacggguauuuucgcuucgauuccugggugaaucaguucuacacacuugcccccaugggcaacggagccggccggagacgcgcucuguga

SEQ ID NO: 28534 - RNA, 1623 nt, Artificial Sequence
  derived and/or modified sequence opt5 from major_capsid_protein__Norovirus__AFU92662
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucuguggcacgcgccucuuggcccggaucugaaccccuaccucucccaucuggcccgcauguauaauggguacgcuggaggcuucgaaguccaggugauccuugccggcaacgcuuuuaccgccgggaaaauuaucuucgcggccguuccucccaauuuuccuacagagggacugucucccagccaggugaccauguucccgcacaucauugucgacgugagacaacucgagccugugcugaucccccugccugauguccggaacaauuuuuaucauuacaaccaguccaaugaccccacaauuaagcucaucgcuaugcuguauacaccccuucgcgccaacaacgcuggcgaugacguuuucaccgugucuugcagagugcugacccggccuagcccggauuuugacuucauuuuucucgugcccccuacggucgaaucccgcaccaaacccuucagcguuccuauccugacaguggaggaaaugaccaauucuagauuucccauuccgcuugagaagcuguucacagggccuuccagcgccuucgucgugcagccccagaacggacgguguaccacggauggcguucuccuggggacaacccaacugucuccugugaauaucugcacauuucgcggagacgucacccacaucgccggcacccagaacuacacaaugaaucucgcuucccagaacuggaauaacuaugaucccacggaggaaauuccugcgccccugggcaccccggacuucguggggaaaauccagggaguccuuacacaaaccacaagacgggacggcagcacccgcgggcauaaggccacggugucuacaggauccauucacuuuaccccuaagcugggcagcguucaguucuccaccgauacaucuaaugacuuugagaccgggcagaacacaagauucacgcccgugggagucgugcaagauggcagcaccacacaccagaaugaaccccagcaguggguucucccuaacuacuccggccgggacagccauaaugugcaccuggcuccggccgucgcccccaccuuuccuggggagcaacuucuguucuuucgcucuacaaugcccggauguuccggcuacccuaacaugaaucucgauugccugcugccccaggaaugggugcagcauuucuaucaggagagcgcuccugcccaaucugacguggcgcuccugagauuuguuaaccccgauaccgggcggguccuuuucgaguguaaacugcacaagagcggauacgugacgguggcucacaccggccagcaugaccucgucaucccgccuaacggguauuuuagauucgauuccugggugaaucaguucuacacacuggcccccaugggcaacggagccggccgccggagagcucuuuga

SEQ ID NO: 28535 - RNA, 1623 nt, Artificial Sequence
  derived and/or modified sequence opt5 from major_capsid_protein__Norovirus__AFU92663
augaagauggccagcaacgacgcuacccccuccgauggcucuacagccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacggugagcccucggaaugcccccggagagauucugugguccgcgccucuuggcccggaucugaaccccuaccucucucaccugagccgcauguauaauggguacgccggaggcuucgaaguccaggugauccuugcuggcaacgccuuuaccgcugggaaaauuaucuucgccgcgguuccucccaauuuuccuacagagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacggucgaaucucgcaccaaacccuucuccguuccuauccugacaguggaggaaaugaccaauagcagauuucccauuccgcuugagaagcuguucacagggccuucuuccgcuuucgucgugcagccccagaacggacgguguaccacggauggcguucuccuggggacaacccaacugagcccugugaauaucugcacauuucgcggaaacgucaccaauaucgccggcucucagaccuacacaaugaaccucgccucccagaauuggaacaauuaugaccccacggaggaaauuccugcuccccugggcaccccggauuucguggggagaauccagggaguccuuacacaaaccacacggggcgacgggagcacccgcggacauaaagcgacgguguccacaggcucugccuacuuuaccccuaagcuggggagcguucaguucuccaccgacacaagcaccgauuuugagacaggacagaacacgagauucacccccgugggcgucgugcaagacggcucuacaacccacaagaaugaaccccagcaguggguucucccuuccuacagcgggcgggauucucauaacgugcaccuggcuccggccgucgcccccacauuuccuggagagcagauucuuuucuuucgcagcaccaugcccggcuguuccggguauccuaauauggaccuggauugccuccugccccaagaaugggugcagcacuucuaccaggagucugcuccugcccagagcgacguggcgcugcucagauuuguuaaccccgauacgggacggguccuguucgaguguaaacuucauaaguccggcuaugugaccguggcucacacagggcaacaugaccuggucaucccgccuaauggcuacuuuagauucgauagcugggugaaccaguucuauacccucgcccccaugggaaacggcgccgggcgccggagagcucuguga

SEQ ID NO: 28536 - RNA, 1623 nt, Artificial Sequence
  derived and/or modified sequence opt5 from major_capsid_protein__Norovirus__AFU92664
augaagauggccagcaacgacgcuaaucccuccgauggcucugccgcgcaccuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcuccagaaacuacaccaugaaucucgcgagccugaacuggaauaacuaugacccuaccgaagagauucccgccccucuugggacacccgauuucgugggaaaaauccagggcguccugacgcagaccacaaagggggacggaucuacccggggccauaaggcuacaguguacaccggguccgccccguuuacgccuaaacucggaagcguucaguucuccacagacaccgaaaaugauuuugagacccaccaaaacacaaaguucacccccgugggcgucauucaggacggcucuacaacgcaccgcaaugaaccccagcaaugggugcugccuagcuacuccgggagaaacguucauaaugugcaccuugccccggcugucgcccccaccuuuccuggagagcagcuccuguucuuucggagcacaaugcccggcuguucuggguauccuaacauggaucuggacugccugcucccccaggagugggugcagcauuucuaccaagaagcggcuccugcccaguccgauguggcccugcuucgcuuuguuaaucccgacaccggaagaguccuguucgaguguaaacuccacaagagcggcuaugugacaguggcucacaccgggcagcaugaucuggucaucccgccuaacggcuacuuucgguucgacucuugggugaaccaguucuauacgcuugcccccaugggaaauggcaccgggagacgccgggcucuguga

SEQ ID NO: 28537 - RNA, 1623 nt, Artificial Sequence
  derived and/or modified sequence opt5 from major_capsid_protein__Norovirus__AFU92666
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucacaguguccugcagagugcugacccggcccagccucgacuuugauuucauuuuucuggucccuccgacaguggagucucgcaccaaacccuucacgguuccuauccuuaccguggaagagaugacaaacuccagauuucccauuccucuggagaaacucuucaccgggcccagcggagccuucgucgugcagccgcagaauggccgguguacaaccgacgggguucugcugggaacgacacaacucucuccugugaacaucugcaccuuucgcggcgaugucacacauaucgcuggcuccagaaauuacaccaugaaccuggcgagccuuaauuggaacaauuaugaccccaccgaagagaccccugcuccccuggggacgccugauuucgugggaaagauucagggcguccucacccagacaaccaagggggacggaucuacacggggccacaaggccaccguguacacgggguccgcccccuuuacaccgaaacugggaagcguucaguucuccaccgacaccgaaaacgauuuugagacacaucaaaauaccaaguucacaccugugggcgucauccaggacggcgggacgacccaccgcaacgaaccccagcaaugggugcuucccucuuacagcggaagaaauguucacaacgugcaucuggccccugcugucgccccgacauuucccggcgagcagcuccuguucuuucgguccaccaugccuggguguagcggauaucccaauauggaucuggacugccuccugccucaggagugggugcagcacuucuaccaagaagcggcucccgcccagucugauguggcccuucugcgcuuuguuaacccugacacaggcagaguccucuucgaguguaaacugcauaaguccggguaugugaccguggcucacacgggccagcacgaucuugucauucccccgaacggauacuuucgguucgacagcugggugaaucaguucuauacccuggccccuaugggcaacgggacaggaagacgccgggcucucuga

SEQ ID NO: 28538 - RNA, 1623 nt, Artificial Sequence
  derived and/or modified sequence opt5 from major_capsid_protein__Norovirus__AFU92667
augaagauggccagcaacgacgcuacccccuccgauggcguggccgcgcaccuggucccugagguuaauaacgaagugauggcucucgagccgguggucggggccgccaucgcugcccccguggcuggacagcaaaauguuauugacccuuggaucagaaacaauuucgugcaggcccccggcggggaauuuacagucucuccucggaacgcgcccggagagauucuguggagcgccccucuuggcccggaucugaaucccuaccucucccaucuggcucgcauguauaacggguacgccggaggcuucgaagugcagguuauccuugcuggcaaugccuuuacggcggggaaaauuaucuucgccgcugugccucccaacuuuccuaccgagggacugucucccagccaggucacaauguucccgcacaucauuguggacgugagacaacucgagccuguccugaucccccugccugauguucggaauaacuuuuaucauuacaaucaguccaacgacucuaccauuaagcucaucgccaugcuguauacaccccuucgcgcuaauaacgccggcgaagauguguucaccgugagcugcagaguccugacacggcccuccccugacuuugauuucauuuuucucgugccgcccaccguugagagccgcacgaaaccuuucaccgugcccauccugacagucgaagagaugaccaacucuagauuuccuauuccccuugagaagcuguucacagggccguccggagccuucgugguucagccucagaauggccgguguaccacggacggggugcuccugggaacaacccaacugagccccgucaacaucugcacauuucgcggcgaugugacccacaucgcuggcucuagaaauuacaccaugaaccucgcgucccugaauuggaacaauuaugacccuacagaagagauucccgccccucuugggacgcccgauuucgucggaaaaauccagggcgugcugacccagacaaccaagggggacggaagcacacggggccauaaggcuaccguuuacacggggucugccccguuuacaccuaaacucggauccgugcaguucagcaccgacaccgaaaacgauuuugagacacaccaaaauaccaaguucacacccgucggcgugauucaggacggcgggacgacccaccgcaacgaaccccagcaauggguucugccuuccuacucuggaagaaaugugcauaacguccaccuugccccggcuguggcccccacauuuccuggcgagcagcuccuguucuuucggagcaccaugcccggguguuccggauauccuaauauggaucuggacugccugcucccccaggagugggugcagcauuucuaccaagaagcggcuccugcccagagcgauguugcccugcuucgcuuugucaaccccgacacaggcagagugcuguucgaguguaaacuccacaagucuggguaugugaccgucgcucacacgggccagcaugaucuggugaucccgccuaauggauacuuucgguucgacuccuggguuaaccaguucuauacccuugcccccaugggcaacgggacaggaagacgccgggcucuguga

SEQ ID NO: 28539 - RNA, 1623 nt, Artificial Sequence
  derived and/or modified sequence opt5 from major_capsid_protein__Norovirus__AFU92668
augaagauggccagcaacgacgugacccccuccgauggcucugcugccaaucuggucccugagguuaacaaugaagugauggcgcucgagccgguggucggggcugccaucgccgcucccguggccggacagcaaaacguuauugacccuuggaucagaaauaacuucgugcaggcucccggcggggaauuuacagucagcccucggaaugcccccggagagauucugugguccgcgccucuuggcccggaucugaaccccuaccucucucaccuggcccgcauguauaauggguacgcuggaggcuucgaagugcagguuauccuugccggcaacgcuuuuacggccgggaaaauuaucuucgcggccgugccucccaauuuuccuaccgagggacugagccccucccaggucacaauguucccgcauaucauuguggacgugagacaacucgagccuguccugaucccccugccugauguucggaacaauuuuuaucacuacaaccagucuaaugacagcaccauuaagcucaucgcuaugcuguauacaccccuucgcgccaacaacgcuggcgaagauguguucaccguguccugcagaguccugacacggcccagcccugacuuugauuucauuuuucucgugccgcccaccguugagucucgcacgaaaccuuucaccgugcccauccugacagucgaagagaugaccaauuccagauuuccuauuccccuugagaagcuguucacagggccgagcggagccuucgugguucagccucagaacggccgguguaccacggacggggugcuccugggaacaacccaacugucucccgucaauaucugcacauuucgcggcgaugugacccauaucgccggcuccagaaacuacaccaugaaucucgcuagccugaacuggaauaacuaugacccuacagaagagauucccgcgccucuugggacgcccgauuucgucggaaaaauccagggcgugcugacccagacaaccaagggggacggaucuacacggggccacaaggccaccguuuacacgggguccgcuccguuuacaccuaaacucggaagcgugcaguucuccaccgacaccgaaaaugauuuugagacacaucaaaacaccaaguucacacccgucggcgugauucaggacggcgggacgacccaccgcaaugaaccccagcaauggguucugccuucuuacagcggaagaaacgugcacaauguccaucuugccccggccguggcucccacauuuccuggcgagcagcuccuguucuuucgguccaccaugcccggguguagcggauauccuaacauggaucuggacugccugcucccccaggagugggugcagcacuucuaccaagaagccgcgccugcucagucugauguugcccugcuucgcuuugucaaucccgacacaggcagagugcuguucgaguguaaacuccauaaguccggguaugugaccgucgcccacacgggccagcacgaucuggugaucccgccuaacggauacuuucgguucgacagcuggguuaaccaguucuauacccuugcucccaugggcaaugggacaggaagacgccgggcccuguga

SEQ ID NO: 28540 - RNA, 1623 nt, Artificial Sequence; identical to SEQ ID NO: 27550
  derived and/or modified sequence opt5 from major_capsid_protein__Norovirus__AFU92669

SEQ ID NO: 28541 - RNA, 1623 nt, Artificial Sequence
  derived and/or modified sequence opt5 from major_capsid_protein__Norovirus__AFU92670
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucuguggcgcgccccucuuggcccggaucugaaucccuaccucucccaccuggcuagaauguauaacggguacgccggaggcuucgaaguccaggugauccuugcuggcaaugccuuuacagcggggaaaauuaucuucgccgcuguuccucccaacuuuccuacggagggacugucucccagccaggugaccauguucccgcauaucauugucgacgugcggcaacucgagccugugcugaucccccugccugauguccgcaauaacuuuuaucacuacaaucaguccaacgacucuacaauuaagcucaucgccaugcuguauacaccccuuagagcuaacaaugccggcgaagauguuuucaccgugagcugccgggugcugacccgccccuccccugacuuugauuucauuuuucucgucccgcccacaguggagagcagaaccaaaccuuucacgguucccauccugaccguggaagagaugacaaacucucgguuuccuauuccccuugagaagcuguucaccgggccguccagcgccuucgucgugcagccucagaauggacgcuguacaaccgacggcguucuccuggggacgacacaacugucucccgugaacaucugcaccuuuagaggagaugucacacauaucgcuggcucccggaauuacaccaugaaccucgcgagccugaauuggaacaauuaugacccuaccgaagaggugcccgccccucuuggcacacccgauuucgucgggaaaauucagggagugcugacgcagaccacaaagggcgacgggucuacccgcggacacaaggcuacaguuuacaccggcuccgccccguuuacgccuaaacucgggagcgugcaguucuccacagacaccgaaaacgauuuugagacccaucaaaauacaaaguucacccccgucggagugauccaggacggcucuacaacgcacagaaacgaaccccagcaauggguucugccuagcuacuccggccggaaugugcacaacguccaucuugccccggcuguggcccccaccuuuccuggggagcagcuccuguucuuucgcagcacaaugcccggauguucuggcuauccuaauauggaucuggacugccugcucccccaggagugggugcagcacuucuaccaagaagcggcuccugcccaguccgauguugcccugcuuagauuugucaaccccgacaccgggcgggugcuguucgaguguaaacuccauaagagcggauaugugacagucgcucacaccggccagcacgaucuggugauuccgccuaacggguacuuuagauucgacucuuggguuaaucaguucuauacgcuugcccccaugggcaacggaaccggccgccggagagcucuguga

SEQ ID NO: 28542 - RNA, 1623 nt, Artificial Sequence
  derived and/or modified sequence opt5 from major_capsid_protein__Norovirus__AFU92671
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucacacauaucgccggcacccaggaguacaccaugaaccucgcuucucagaauuggaacaauuaugaucccacagaagagauuccugcgccccugggcacgccggacuucguggggaagauccagggaguccuuacccaaacaacccggcgcgacggcuccacaagagggcacaaagccaccgugagcacgggauccguucauuuuacaccuaagcugggccggauucaguucucuaccgauaccagcaacgacuuugaaacagggcagaauacccgcuucacacccgugggagucgugcaagauggcuccacgacccaccagaacgagccccagcaguggguucucccugacuacagcggcagagauucucacaaugugcaucuggcuccggccgucgcccccuccuuuccuggggaacaacuucuguucuuucggagcacaaugcccggauguucuggcuacccuaacaugaaucucgacugccugcugccccaggagugggugcagcacuucuaucaggaggcugccccugcgcaaagcgauguggcucuccugagauuuguuaaccccgacaccgggcgcguccuuuucgaauguaagcugcauaaauccggauacgugacaguggcccacaccggccagcacgaucucgucaucccgccuaauggguauuuucgguucgacucuugggugaaccaguucuacacgcuggcccccaugggcaacggaaccggcagacgccgggcucuuuga

SEQ ID NO: 28543 - RNA, 1623 nt, Artificial Sequence
  derived and/or modified sequence opt5 from major_capsid_protein__Norovirus__AFU92672
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagacacccgccccucuugggacgcccgauuucgugggaaaaauucagggcguccugacccagacaaccaagggggacggaucuacacggggccacaaggcuaccguguacacgggguccgccccguuuacaccuaaacucggaagcguucaguucuccaccgacaccgaaaacgauuuugagacacaucaaaauaccaaguucacacccgugggcgucauccaggacggcgggacgacccaccgcaacgaaccccagcaaugggugcugccuucuuacagcggaagaaauguucacaacgugcaucuugccccggcugucgcccccacauuuccuggcgagcagcuccuguucuuucgguccaccaugcccggguguagcggauauccuaauauggaucuggacugccugcucccccaggagugggugcagcacuucuaccaagaagcggcuccugcccagucugauguggcccugcuucgcuuuguuaaccccgacacaggcagaguccuguucgaguguaaacuccauaaguccggguaugugaccguggcucacacgggccagcacgaucuggucauuccgccuaacggauacuuucgguucgacagcugggugaaucaguucuauacccuugcccccaugggcaacgggacaggaagacgccgggcucuguga

SEQ ID NO: 28544 - RNA, 1623 nt, Artificial Sequence
  derived and/or modified sequence opt5 from major_capsid_protein__Norovirus__AFU92673
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgcuguccagccucagaauggccgguguacaaccgacggggugcuccugggaacgacacaacugucucccguuaacaucugcaccuuucgcggcgaugugacacauaucgcgggcuccagaaauuacaccaugaaccucgccagccugaauuggaacaauuaugacccuaccgaagagauucccgcuccucuugggacacccgauuucgucggaaaaauccagggcgugcugacgcagaccacaaagggggacggaucuacccggggccacaaggccacagucuacaccggguccgccccguuuacgccuaaacucggaagcgugcaguucuccacagacaccgaaaacgauuuugagacccaucaaaauacaaaguucacccccguuggcgugauucaggacggcgggacaacgcaccgcaacgaaccccagcaauggguccugccuucuuacagcggaagaaaugugcacaacguucaucuugcuccggccguggcgcccaccuuuccuggcgagcagcuccuguucuuucgguccacaaugcccggguguagcggauauccuaauauggaucuggacugccugcucccccaggaguggguccagcacuucuaccaagaagcugccccugcccagucugauguggcucugcuucgcuuugugaaccccgacaccggcagaguucuguucgaguguaaacuccauaaguccggguaugccacagucgcucacaccggccagcacgaucuggugaucccgccuaacggauacuuucgguucgacagcugggugaaucaguucuauacgcuugcccccaugggcaacgggaccggaagacgccgggcgcuguga

SEQ ID NO: 28545 - RNA, 1623 nt, Artificial Sequence
  derived and/or modified sequence opt5 from major_capsid_protein__Norovirus__AFU92674
augaagauggccagcaacgacgcucaccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcuccagaaacuacaccaugaaucucgcgagccugaacuggaccaauuaugacccuacagaagagauucccgccccucuugggacgcccgauuucgugggaaaaauccagggcguccugacccagacaaccaagggggacggaucuacacggggccauaaggcuaccguguacacgggguccgccccguuuacaccuaaacucggaagcguucaguucuccaccgacaccgaaaacgauuuugagacacaccaaaauaccaaguucacacccgugggcgucauucaggacggcgggacgacccaccgcaacgaaccccagcaaugggugcugccuucuuacagcggaagaaauguucauaacgugcaccuugccccggcugucgcccccacauuuccuggcgagcagcuccuguucuuucgguccaccaugcccggguguagcggauauccuaauauggaucuggacugccugcucccccaggagugggugcagcauuucuaccaagaagcggcuccugcccagucugauguggcccugcuucgcuuuguuaaccccgacacaggcagaguccuguucgaguguaaacuccacaaguccggguaugugaccguggcucacacgggccagcaugaucuggucaucccgccuaauggauacuuucgguucgacagcugggugaaccaguucuauacccuugcccccaugggcaacgggacaggaagacgccgggcucuguga

SEQ ID NO: 28546 - RNA, 1623 nt, Artificial Sequence
  derived and/or modified sequence opt5 from major_capsid_protein__Norovirus__AFU92676
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacuccuacgcugggggauucgaaguccaggugauccuugccggcaaugcuuuuacggccggcaaaauuaucuucgcggccguuccucccaacuuuccuaccgaggggcugucucccagccaggugacaauguucccgcacaucauugucgacgugagacaacucgagccugugcugaucccccugccugauguccggaauaacuuuuaucauuacaaucaguccaacgaccccaccauuaagcucaucgcuaugcuguauacaccccuucgcgccaauaacgcuggagaugacguuuucaccgugagcugcagagugcugacacggccuucuccggauuuugacuucauuuuucucgugcccccuaccgucgaaucccgcacgaaacccuucagcguuccuauccugaccguggaggaaaugacaaacucuagauuucccauuccgcuugagaagcuguucaccggcccuuccagcgccuucgucgugcagccccagaaugggcgguguacaaccgauggaguucuccugggcacgacacaacugucuccugugaacaucugcaccuuucgcggggacgucacacacaucgccggaacccaggaguacaccaugaaucucgcuucccagaacuggaauaacuaugaucccacagaagagauuccugcgccccugggcacgccggacuucgugggcaaaauccaggggguccuuacccaaacaaccagcagagacggauccacacggggccauaaggccaccgugucuacggggagcguucacuuuacaccuaagcugggacgcgugcaguucuccaccgauaccagcaaugacuuugaaacaggccagaacaccagauucacacccgucggggugguucaagauggaucuacgacccaccagaaugagccccagcagugggugcucccuaacuacuccggccgggacagccauaauguccaccuggcuccggccguggcccccucuuuuccuggcgaacaacuucuguucuuucgcagcacaaugcccggguguuccggauacccuaacaugaaucucgauugccugcugccccaggagugggugcagcauuucuaucaggaggcugccccugcgcaaucugacguugcucuccugagauuugucaaccccgauaccggccgggugcuuuucgaauguaaacugcacaagagcggguacgugacagucgcccacaccggacagcaugaccucgugauuccgccuaauggcuauuuuagauucgauuccuggguuaaccaguucuacacgcuggcccccauggggaacggcaccggacgccggagagcucuuuga

SEQ ID NO: 28547 - RNA, 1623 nt, Artificial Sequence
  derived and/or modified sequence opt5 from major_capsid_protein__Norovirus__AFU92677
augaagauggccagcaacgacgcucaccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcuccagaaacuacaccaugaaucucgcgagccugaacuggaauaacuaugacccuaccgaagagauucccgccccucuugggacacccgauuucgugggaaaaauccagggcguccugacgcagaccacaaagggggacggaucuacccggggccauaaggcuacaguguacaccggguccgccccguuuacgccuaaacucggaagcguucaguucuccacagacaccgaaaaugauuuugagacccaccaaaacacaaaguucacccccgugggcgucauucaggacggcgggacaacgcaccgcaaugaaccccagcaaugggugcugccuucuuacagcggaagaaacguucauaaugugcaccuugccccggcugucgcccccaccuuuccuggcgagcagcuccuguucuuucgguccacaaugcccggguguagcggauauccuaacauggaucuggacugccugcucccccaggagugggugcagcauuucuaccaagaagcggcuccugcccagucugauguggcccugcuucgcuuuguuaaucccgacaccggcagaguccuguucgaguguaaacuccacaaguccggguaugugacaguggcucacaccggccagcaugaucuggucaucccgccuaacggauacuuucgguucgacagcugggugaaccaguucuauacgcuugcccccaugggcaaugggaccggaagacgccgggcucuguga

SEQ ID NO: 28548 - RNA, 1623 nt, Artificial Sequence
  derived and/or modified sequence opt5 from major_capsid_protein__Norovirus__AFU92678
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcgagccugaauuggaacaauuaugacccuaccgaagagauucccgccccucuugggacacccgauuucgugggaaaaauccagggcguccugacgcagaccacaaagggggacggaucuacccggggccacaaggcuacaguguacaccggguccgccccguuuacgccuaaacucggaagcguucaguucuccacagacaccgaaaacgauuuugagacccaucaaaauacaaaguucacccccgugggcgucauucaggacggcgggacaacgcaccgcaacgaaccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaucuggacugccugcucccccaggagugggugcagcacuucuaccaagaagcggcuccugcccaguaugauguggcccugcuucgcuuuguuaaccccgacaccggcagaguccuguucgaguguaaacuccauaagucuggguacgugacaguggcucacaccggccagcacgaucuggucaucccgccuaacggauauuuucgguucgacuccugggugaaucaguucuacacgcuugcccccaugggcaacgggaccggaagacgccgggcucuguga

SEQ ID NO: 28549 - RNA, 1623 nt, Artificial Sequence
  derived and/or modified sequence opt5 from major_capsid_protein__Norovirus__AFU92679
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugaguuugacuucauuuuucucgucccgcccacaguggaaucucgcaccaaaccuuucacgguucccauccugaccguggaggagaugacaaacuccagauuuccuauuccccuugaaaagcuguucaccgggccgagcggagccuucgucgugcagccucagaauggccgguguacaaccgaugggguucuccugggaacgacacaacugucucccgugaacaucugcaccuuucgcggcgacgucacacauaucgcuggcuccagaaauuacaccaugaaccucgcgagccugaauuggaacaauuaugauccuaccgaggaaauucccgccccucuugggacacccgacuucgugggaaaaauccagggcguccugacgcagaccacaaagggggauggaucuacccggggccacaaggcuacaguguacaccggguccgccccguuuacgccuaaacucggaagcguucaguucuccacagacaccgagaacgacuuugaaacccaucaaaauacaaaguucacccccgugggcgucauucaggauggcgggacaacgcaccgcaacgagccccagcaaugggugcugccuucuuacagcggaagaaauguucacaacgugcaucuugccccggcugucgcccccaccuuuccuggcgagcagcuccuguucuuucgguccacaaugcccggguguagcggauauccuaauauggaccuggauugccugcucccccaggaaugggugcagcacuucuaccaagaggcggcuccugcccagucugacguggcccugcuucgcuuuguuaaccccgauaccggcagaguccuguucgaauguaaacuccauaaguccggguaugugacaguggcucacaccggccagcacgaccuggucaucccgccuaacggauacuuucgguucgauagcugggugaaucaguucuauacgcuugcccccaugggcaacgggaccggaagacgccgggcucuguga

SEQ ID NO: 28550 - RNA, 1623 nt, Artificial Sequence; identical to SEQ ID NO: 27550
  derived and/or modified sequence opt5 from major_capsid_protein__Norovirus__AFU92680

SEQ ID NO: 28551 - RNA, 1623 nt, Artificial Sequence; identical to SEQ ID NO: 26945
  derived and/or modified sequence opt5 from major_capsid_protein__Norovirus__AFU92681

SEQ ID NO: 28552 - RNA, 1623 nt, Artificial Sequence; identical to SEQ ID NO: 26945
  derived and/or modified sequence opt5 from major_capsid_protein__Norovirus__AFU92682

SEQ ID NO: 28553 - RNA, 1623 nt, Artificial Sequence; identical to SEQ ID NO: 27629
  derived and/or modified sequence opt5 from major_capsid_protein__Norovirus__AFU92684

SEQ ID NO: 28554 - RNA, 1623 nt, Artificial Sequence
  derived and/or modified sequence opt5 from major_capsid_protein__Norovirus__AFU92685
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagcggcuguucaccgggccuucuuccgccuucgucgugcagccccagaacggacgcuguacaaccgauggcguucuccuggggacgacacaacugagcccugugaauaucugcaccuuuagaggagacgucgcccauaucgcuggcacacaggaguacaccaugaaccucgcgucucagaauuggaacaauuaugaucccaccgaagagauuccugcuccccugggcacaccggacuucguggggaagauccagggaguccuuacgcaaaccacacggcgcgacggcuccaccagagggcacaaagccacagugagcaccggauccguucauuuuacgccuaagcugggccggauucaguucucuacagauaccagcaacgacuuugaaaccgggcagaauacacgcuucacccccgugggagucgugcaagauggcggcacaacgcaccagaacgagccccagcaguggguucucccugacuacuccgggagagauagccacaaugugcaucuggccccggccgucgcucccucuuuuccuggagaacaacuucuguucuuucgguccaccaugcccggcuguagcggguacccuaacaugaaucucgacugccugcugccccaggagugggugcagcacuucuaucaggaggccgcgccugcucaaucugauguggcccuccugagauuuguuaaccccgacacaggacgcguccuuuucgaauguaagcugcauaaaagcggcuacgugaccguggcccacacagggcagcacgaucucgucaucccgccuaauggcuauuuucgguucgacuccugggugaaccaguucuacacccuggcucccaugggaaacggcacggggagacgccgggcccuuuga

SEQ ID NO: 28555 - RNA, 1623 nt, Artificial Sequence
  derived and/or modified sequence opt5 from major_capsid_protein__Norovirus__AFU92686
augaagauggccagcaacgacgcucaccccuccgauggcucugccgcgacccuggugccuaaagucaauaacgagguuauggcucucgaaccgguggugggggccgccaucgcugcccccgucgcuggacagcaaaaugugauugacccuuggaucagaaacaauuucguucaggcccccggcggggaguuuacagugagcccucggaacgcgcccggagaaauucugugguccgccccucuuggcccggaucugaaucccuaccucucucaucuggcucgcauguauaacggguacgccggaggcuucgagcuucacguccugcucgcuggcaaugccuuuacggcggggaagaucauuaucgccgcugugccucccaacuucccuaccgaaggacugagccccucccagguuacaauguuuccgcauaucauuguggacgucagacagcuggagccugugcucaucccccugccugaugugcggaauaacuucuaucacuacaaucaaucuaacgacagcaccauuaaacuuaucgccaugcuguauacaccccuccgcgcuaauaacgccggcgaggaugucuuuaccguuuccugcagagugcugacacggcccagcccugacuucgauuuuauuuuccuugugccgcccaccgucgaaucucgcacgaagccuuuuaccgugcccauccugacaguugaggaaaugaccaacuccagauucccuauuccccucgagaaacuguuuacagggccgagcggagccuucgugguccagccucagaauggccgguguaccacggacggggugcugcucggaacaacccagcugucucccguuaacaucugcaucuuccgcggcgaugugacacauauugcuggcuccagaaauuacaccaugaaccuugcggcccugaauuggaacaauuaugacccuaccgaggaaauccccgcuccucucgggacacccgauuuugucggaaagauucaaggcgugcugacgcagaccacaaagggggacggaagcacccggggccacaaagccacagucuacaccgggucugccgacuucacgccgaaacuuggauccgugcaguuuagcacagauaccgagaacgacuucgaaacccaccagaauacaaaguuuaccccuguuggcgugauccaagauggcuccacaacgcaucgcaacgagccccagcaguggguccugcccucuuacagcgggagaaaugugcacaacguucaucucgcuccugccguggcgccgaccuuccccggagaacaacugcuguuuuuccgguccacaaugccuggcuguagcggguaucccaauauggaccucgauugccugcuuccucaggaguggguccagcacuuuuaccaggaggcugcccccgcccaaucugacguggcucugcuccgcuucgugaacccugauaccggaagaguucuguuugaauguaaacuucacaaguccggcuaugucacaguggcccauaccgggcagcacgaccuggugauucccccgaauggcuacuuccgguuugauagcugggucaaccaguucuauacgcucgcuccuaugggaaacggcaccgggagacgccgggcccuguga

SEQ ID NO: 28556 - RNA, 1623 nt, Artificial Sequence
  derived and/or modified sequence opt5 from major_capsid_protein__Norovirus__AFU92687
augaagauggccagcaacgaccccaauccuuccgauggcucugcugccaaccuggugccggaggucaauaacgaaguuauggcgcucgagcccguggugggggcugccaucgccgcuccugucgccggacagcaaaaugugauugaccccuggaucagaaacaauuucguucaggcuccuggcggggaauuuaccgugagcccccggaacgccccuggagagauucugugguccgcgccgcuuggccccgaucugaauccuuaccucucucaccuggcccgcauguauaacggguacgcuggaggcuucgaaguccaggugauccuugccggcaaugcuuuuacagccgggaaaauuaucuucgcggccguucccccuaacuuucccacggagggacugagcccgucccaggugaccauguucccucauaucauugucgacgugagacaacucgagcccgugcugaucccucugcccgauguccggaauaacuuuuaucacuacaaucagucuaacgacagcacaauuaagcucaucgcuaugcuguauacaccccuucgcgccaacaaugcuggcgaagauguuuucaccguguccugcagagugcugacccggccuagcccggacuuugauuucauuuuucucgugcccccuacagucgagucucgcaccaaacccuucacgguuccuauccugaccguggaagagaugacaaacuccagauuucccauuccgcuugagaagcuguucaccgggccuagcggagccuucgucgugcagccccagaauggccgguguacaaccgacgggguucuccugggaacgacacaacugucuccugugaacaucugcaccuuucgcggcgaugucacacauaucgccggcaccagaaauuacaccaugaaccucgcuucccugaauuggaacaauuaugaccccacagaagagauuccugcgccccuugggacgccggauuucgugggaaaaauccagggcguccugacccagacaaccaagggggacggaagcacacggggccacaaggccaccguguacacggggucugcuccuuuuacacccaaacucggauccguucaguucagcaccgacaccgaaaacgauuuugagacacaucaaaauaccaaguucacacccgugggcgucauucaggacggcgggacgacccaccgcaacgaaccucagcaaugggugcugccguccuacucuggaagaaauguucacaacgugcaucuugcccccgccgucgcuccuacauuucccggcgagcagcuccuguucuuucggagcaccaugccuggguguuccggauaucccaauauggaucuggacugccugcucccucaggagugggugcagcacuucuaccaagaagccgcgcccgcucagagcgauguggcccugaugcgcuuuguuaacccggacacaggcagaguccuuuucgaguguaaacugcauaagucuggguaugugaccguggcccacacgggccagcacgaucucgucaucccucccaacggauacuuucgguucgacuccugggugaaucaguucuauacccuggcuccuaugggcaacgggacaggaagacgccgggcccuuuga

SEQ ID NO: 28557 - RNA, 1623 nt, Artificial Sequence
  derived and/or modified sequence opt5 from major_capsid_protein__Norovirus__AFU92688
augaagauggccagcaacgacgcucaccccuccgauggcucugccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccgugagcccucggaaugcgcccggagagauucugugguccgccccucuuggcccggaucugaaccccuaccucucucaucuggcucgcauguauaauggguacgccggaggcuucgaaguccaggugauccuugcuggcaacgccuuuacagcggggaaaauuaucuucgccgcuguuccucccaauuuuccuacggagggacugagccccucccaggugaccauguucccgcacaucauugucgacgugagacaacucgagccugugcugaucccccugccugauguccggaacaauuuuuaucauuacaaccagucuaaugacagcacaauuaagcucaucgccaugcuguauacaccccuucgcgcuaacaacgccggcgaagauguuuucaccguguccugcagagugcugacccggcccagcccugacuuugauuucauuuuucucgucccgcccacaguggagucucgcaccaaaccuuucacgguucccauccugaccguggaagagaugacaaauuccagauuuccuauuccccuugagaagcuguucaccgggccgagcggagccuucgucgugcagccucagaacggccgguguacaaccgacgggguucuccugggaacgacacaacugucucccgugaauaucugcaccuuucgcggcgaugucacacacaucgcuggcaccagaaacuacaccaugaaucucgcgucccugaacuggaauaacuaugacccuacagaagagauucccgccccucuugggcccccggauuucgugggaaaaauccagggcguccugacgcagaccacaaagggggacggaagcacccggggccauaaggcuacaguguacaccgggucugccccuuuuacgcccaaacucggauccguucaguucagcacagacaccgaaaaugauuuugagacccaccaaaacacaaaguucacccccgugggcgucauucaggacggcgggacaacgcaccgcaaugaaccucagcaaugggugcugccguccuacucuggaagaaacguucauaaugugcaccuugcccccgcugucgccccuaccuuucccggcgagcagcuccuguucuuucggagcacaaugccuggguguuccggauaucccaacauggaucuggacugccugcucccucaggagugggugcagcauuucuaccaagaagcggcucccgcccagagcgauguggcccugaugcgcuuuguuaauccggacaccggcagaguccuuuucgaguguaaacugcacaagucuggguaugugacaguggcucacaccggccagcaugaucucgucaucccucccaacggauacuuucgguucgacuccugggugaaccaguucuauacgcuggccccuaugggcaaugggaccggaagacgccgggcucuuuga

SEQ ID NO: 28558 - RNA, 1623 nt, Artificial Sequence; identical to SEQ ID NO: 26972
  derived and/or modified sequence opt5 from major_capsid_protein__Norovirus__AFU92689

SEQ ID NO: 28559 - RNA, 1623 nt, Artificial Sequence; identical to SEQ ID NO: 26972
  derived and/or modified sequence opt5 from major_capsid_protein__Norovirus__AFU92690

SEQ ID NO: 28560 - RNA, 1623 nt, Artificial Sequence; identical to SEQ ID NO: 26972
  derived and/or modified sequence opt5 from major_capsid_protein__Norovirus__AFU92691

SEQ ID NO: 28561 - RNA, 1623 nt, Artificial Sequence; identical to SEQ ID NO: 27629
  derived and/or modified sequence opt5 from major_capsid_protein__Norovirus__AFU92692

SEQ ID NO: 28562 - RNA, 1623 nt, Artificial Sequence
  derived and/or modified sequence opt5 from major_capsid_protein__Norovirus__AFU92693
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaagcaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaaacuacaccaugaaucucgcgucccugaacuggaauaacuaugacccuaccgaagagauucccgccccucuuggcacacccgauuucguggggaaaauccagggaguccugacgcagaccacaaagggcgacgggagcacccggggacacaaggcuacaguguacaccggcuccgccccguuuacgccuaaacucgggucuguucaguucagcacagacaccgaaaaugauuuugagacccaucaaaacacaaaguucacccccgugggagucauucaggacggcggcacaacgcaccgcaaugaaccccagcaaugggugcugccuuccuacagcgggagaaacguuccgaaugugcaccuugcccccgcugucgccccuaccuuucccggagagcagcuccuguucuuucggucuacaaugccuggcuguuccggguaucccaacauggaucuggacugccugcucccucaggagugggugcagcauuucuaccaagaagcggcucccgcccagagcgauguggcccugcuucgcuuuguuaauccggacaccggaagaguccuguucgaguguaaacuccacaagucuggcuaugugacaguggcucauaccgggcagcacgaucuggucaucccucccaacggcuacuuucgguucgacagcugggugaaccaguucuauacgcuugccccuaugggaaauggcaccgggagacgccgggcucuguga

SEQ ID NO: 28563 - RNA, 1623 nt, Artificial Sequence; identical to SEQ ID NO: 27022
  derived and/or modified sequence opt5 from major_capsid_protein__Norovirus__AFU92694

SEQ ID NO: 28564 - RNA, 1623 nt, Artificial Sequence; identical to SEQ ID NO: 27081
  derived and/or modified sequence opt5 from major_capsid_protein__Norovirus__AFU92695

SEQ ID NO: 28565 - RNA, 1623 nt, Artificial Sequence; identical to SEQ ID NO: 27607
  derived and/or modified sequence opt5 from major_capsid_protein__Norovirus__AFU92696

SEQ ID NO: 28566 - RNA, 1623 nt, Artificial Sequence; identical to SEQ ID NO: 27081
  derived and/or modified sequence opt5 from major_capsid_protein__Norovirus__AFU92697

SEQ ID NO: 28567 - RNA, 1623 nt, Artificial Sequence; identical to SEQ ID NO: 26932
  derived and/or modified sequence opt5 from major_capsid_protein__Norovirus__AFU92698

SEQ ID NO: 28568 - RNA, 1623 nt, Artificial Sequence
  derived and/or modified sequence opt5 from major_capsid_protein__Norovirus__AFU92699
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauucucgacgucagacaacuggagccugugcugaucccccucccugaugugcggaauaacuuuuaucacuacaaucagucuaacgacagcacaauuaagcugaucgccaugcuuuauacaccccugcgcgcuaacaaugccggcgaagaugucuucaccguuuccugcagagugcucacccggcccagcccugacuuugauuucauuuuucuggugccgcccacagucgagucucgcaccaaaccuuucacggugcccauccuuaccguugaagagaugacaaacuccagauuuccuauuccccuggagaaacucuucaccgggccgagcggagccuucgugguccagccucagaauggccgguguacaaccgacggggugcugcugggaacgacacaacucucucccguuaacaucugcaccuuucgcggcgaugugacacauaucgcuggcuccagaaauuacaccaugaaccuggcgagccuuaauuggaacaauuaugacccuaccgaagagauucccgccccucuggggacacccgauuucgucggaaagauccagggcgugcucacgcagaccacaaagggggacggaucuacccggggccacaaggcuacagucuacaccggguccgccccguuuacgccuaaacugggaagcgugcaguucuccacagacaccgaaaacgauuuugagacccaucaaaauacaaaguucacccccguuggcgugauucaggacggcucuacaacgcgcagaaacgaaccccagcaauggguccuuccuagcuacuccgggcggaaugcccacaacgugcaccuggcuccggccguugcgcccaccuuuccuggagagcagcuccuguucuuucgcagcacaaugcccggcuguucuggguauccuaauauggaucuggacugccuccugccccaggagugggugcagcauuucuaccaagaagcugccccugcccaguccgaugucgcucuccugagauuugugaaccccgacaccggacgggugcuuuucgaguguaaacugcacaagagcggcuauguuacagucgcccauaccgggcagcacgaucuugugaucccgccuaacggcuacuuuagauucgacucuugggugaaucaguucuauacgcuggcucccaugggaaacggcaccgggcgccggagagcccucuga

SEQ ID NO: 28569 - RNA, 1623 nt, Artificial Sequence
  derived and/or modified sequence opt5 from major_capsid_protein__Norovirus__AFU92700
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaguccugacgcagaccacaaagggcgacgggagcacccggggacacaaggcuacaguguacaccggcuccgccccguuuacgccuaaacucgggucuguucaguucagcacagauaccgaaaacgacuuugagacccaucaaaauacaaaguucacccccgugggagucauucaggauggcuccacaacgcaccgcaacgaaccccagcaaugggugcugccuagcuacucuggcagaaauguucagaacgugcaccuugccccggcugucgcccccaccuuuccuggggagcagcuccuguucuuucgguccacaaugcccggauguagcggcuauccuaauauggaccuggauugccugcucccccaggagugggugcaacauuucuaccaggaagcggcuccugcccagucugacguggcccugcuucgcuuuguuaaccccgauaccgggagaguccuguucgaguguaaacuccacaagagcggauaugugacaguggcucauaccggccagcacgaccuggucaucccgccuaauggguacuuucgguucgauuccugggugaaccaauucuauacgcuugcccccaugggcaacggaaccggcagacgccgggcucuguga

SEQ ID NO: 28570 - RNA, 1623 nt, Artificial Sequence; identical to SEQ ID NO: 27081
  derived and/or modified sequence opt5 from major_capsid_protein__Norovirus__AFU92701

SEQ ID NO: 28571 - RNA, 1623 nt, Artificial Sequence; identical to SEQ ID NO: 27022
  derived and/or modified sequence opt5 from major_capsid_protein__Norovirus__AFU92702

SEQ ID NO: 28572 - RNA, 1623 nt, Artificial Sequence
  derived and/or modified sequence opt5 from major_capsid_protein__Norovirus__AFU92703
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcucugccuucgucgugcagccucagaauggacgguguacaaccgacggcguucuccuggggacgacacaacugucccccgugaacaucugcaccuuucgcggagaugucacacauaucgcuggcagcagaaauuacaccaugaaccucgcgucucugaauuggaacaauuaugacccuaccgaagagauucccgccccucuuggcacacccgauuucguggggaaaauccagggaaugcugacgcagaccacaaagggcgacggguccacccggggacacaaggcuacagucuacaccggcagcgccccguuuacgccuaaacucggguccgugcaguucucuacagacaccgaaaacgauuuugagacccaucaaaauacaaaguucacccccguuggagugauucaggacggcagcacaacgcaccgcaacgaaccccagcaauggguccugccuuccuacagcggcagaaaugugcagaacguucaccuugccccggcuguggcccccaccuuuccuggggagcagcuccuguucuuucggucuacaaugcccggauguuccggcuauccuaauauggaucuggacugccugcucccccaggaguggguccaacauuucuaccaggaagcggcuccugcccagagcgauguggcccugcuucgcuuugugaaccccgacaccgggagaguucuguucgaguguaaacuccacaagucuggauaugucacaguggcucauaccggccagcacgaucuggugaucccgccuaacggguacuuucgguucgacagcugggucaaucaauucuauacgcuugcccccaugggcaacggaaccggcagacgccgggcucuguga

SEQ ID NO: 28573 - RNA, 1623 nt, Artificial Sequence
  derived and/or modified sequence opt5 from major_capsid_protein__Norovirus__AFU92704
augaagauggccagcuccgacgcuaaccccucugauggcagcaccgcccaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacauccccggcucuagaaauuacaccaugaaccucgccucccagaauuggaacagcuaugauccuaccgaggaaauccccgcuccgcugggcacaccugacuucgucgggaaaauucagggagugcuuacgcagaccacacggaccaauggcuccacacgcgggcauaaggcgaccguuuacacgggaucugccgacuuuagccccaagcugggcagagugcaauucgcuacagauaccgacaacgauuuugagaccaaucagaacacaaaauucacccccgucggggugauccaggacggauccacaacgccucggaaugaaccgcaacaguggguucuccccagcuacucuggccgcaacauucacaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcauaaaagcggguacgugacaguggcccacaccggacagcaugaucucgucauucccccuaacggcuauuuucgcuucgacuccugggugaaccaauucuacacgcuggcucccauggggaauggcaccggacggagacgcgcccuuuga

SEQ ID NO: 28574 - RNA, 1623 nt, Artificial Sequence; identical to SEQ ID NO: 26932
  derived and/or modified sequence opt5 from major_capsid_protein__Norovirus__AFU92705

SEQ ID NO: 28575 - RNA, 1623 nt, Artificial Sequence; identical to SEQ ID NO: 26522
  derived and/or modified sequence opt5 from major_capsid_protein__Norovirus__AFU92706

SEQ ID NO: 28576 - RNA, 1623 nt, Artificial Sequence
  derived and/or modified sequence opt5 from major_capsid_protein__Norovirus__AFU92707
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagaguggaguucgcuacagauaccgacaaugauuuugaaaccaaccaaaauacaaaauucacccccgucggggugauccaggacggauccacaacgccucggaacgagccgcagcaauggguucuccccagcuacucuggccgcaauauucauaacgugcaccuggccccugccgucgcucccaccuuuccuggcgaacagcuucuguucuuuagauccacaaugcccggguguagcggauauccuaauauggaucucgacugccugcugccccaggagugggugcaguacuucuaucaagaggccgcgccggcucagucugauguggcccuccugcgguuuguuaacccugacaccggcagaguccuuuucgaauguaagcugcacaaaagcggguacgugacaguggcccauaccggacagcacgaucucgucauucccccuaacggcuauuuucgcuucgacuccugggugaaucaguucuacacgcuggcucccauggggaacggcaccggacggagacgcgcccuuuga

SEQ ID NO: 28577 - RNA, 1623 nt, Artificial Sequence
  derived and/or modified sequence opt5 from major_capsid_protein__Norovirus__AFU92708
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaagauguuuucaccguguccugcagagugcugacccggcccagcccugacuuugauuucauuuuucucgucccgcccacaguggagucucgcaccaaaccuuucacgguucccauccugaccguggaagagaugacaaacuccagauuuccuauuccccuugagaagcuguucaccgggccgagcggagccuucgucgugcagccucagaauggccgguguacaaccgacgggguucuccugggaacgacacaacugucucccgugaacaucugcaccuuucgcggcgaugucacacauaucgcuggcuccagaaauuacaccaugaaccucgcggcccugaauuggaacaauuaugacccuaccgaagagauucccgcuccucuugggacacccgauuucgugggaaaaauccagggcguccugacgcagaccacaaagggggacggaagcacccggggccacaaggccacaguguacaccgggucugccgacuuuacgccgaaacucggauccguucaguucagcacagauaccgaaaacgacuuugagacccaucaaaauacaaaguucaccccugugggcgucauucaggauggcuccacaacgcaccgcaacgaaccccagcaaugggugcugcccucuuacagcgggagaaauguucacaacgugcaucuugcuccugccgucgcgccgaccuuucccggagagcagcuccuguucuuucgguccacaaugccuggcuguagcggguaucccaauaugaaccuggacugccugaucccucaggagugggugcagcacuucuaccaagaagcugcccccgcccagucugauguggcucuccugcgcuuuguuaacccugacaccggaagaguccuuuucgaguguaaacugcauaaguccggcuaugugacaguggcccacaccgggcagcacgaucucgucauucccccgaauggcuacuuucgguucgacagcugggugaaccaguucuauacgcuggcuccuaugggaaauggcgccgggagacgccgggcgcuuuga

SEQ ID NO: 28578 - RNA, 1623 nt, Artificial Sequence; identical to SEQ ID NO: 26522
  derived and/or modified sequence opt5 from major_capsid_protein__Norovirus__AFU92709

SEQ ID NO: 28579 - RNA, 1623 nt, Artificial Sequence; identical to SEQ ID NO: 26522
  derived and/or modified sequence opt5 from major_capsid_protein__Norovirus__AFU92710

SEQ ID NO: 28580 - RNA, 1623 nt, Artificial Sequence; identical to SEQ ID NO: 26522
  derived and/or modified sequence opt5 from major_capsid_protein__Norovirus__AFU92711

SEQ ID NO: 28581 - RNA, 1623 nt, Artificial Sequence
  derived and/or modified sequence opt5 from major_capsid_protein__Norovirus__AFU92712
augaagauggccagcaacgacgcuaaucccuccgagggcucugccgcgaaccuggugccugaagucaauaacgagguuauggcucucgaaccgguggugggggccgccaucgcugcccccgucgcuggacagcaaaaugugauugauccuuggaucagaaacaauuucguucaggcccccggcggggaguuuaccgugagcccucggaacgcgcccggaacaauucgcugguccgccccucugggcccggaccuuaaucccuaccugucucaccucgcuagaauguauaacggguacgccggaggcuucgaaguccaggugauccuggcuggcaaugccuuuacggcggggaaaauuaucuucgccgcuguuccucccaacuuuccuaccgagggacuuagccccucccaggugacaauguucccgcauaucauugucgaugugcggcaacuggagccugugcucaucccccugccugacguccgcaauaacuuuuaucacuacaaucagucuaacgauagcaccauuaagcugaucgccaugcucuauacaccccugagagcuaacaaugccggcgaagacguuuucaccguguccugccgggugcuuacacgccccagcccugauuuugacuucauuuuucuggucccgcccaccguggagucuagaacgaaaccuuucaccguucccauccucacaguggaagagaugaccaacucccgguuuagcauuccucuggagaaacuuuucacagggcccucuggagccuucgucgugcagccgcagaauggccgcuguaccacggaugggguucugcucggaacaacccaacuguccccugugaacaucugcacauuuagaggcgacgucacccauaucgcuggcagccggaauuacaccaugaaccuggcggcccucaauuggaacaauuaugaucccacagaagagauuccugcuccccuggggacgccugacuucgugggaaagauccagggcguccuuacccagacaaccaagggggauggaucuacacgcggccacaaggccaccguguacacgggguccgccgacuuuacacccaaacugggaagcguucaguucuccaccgacaccgaaaacgauuuugagucucaucaaaauacaaaguucaccccggugggcgucauucaggacggcagcacaacgcacagaaacgaaccucagcaaugggugcuccccuccuacagcgggcggaauguucacaacgugcaucuggcucccgccgucgcgccuaccuuuccgggagagcagcuucuguucuuucgcucuacaaugcccggcuguuccggguauccuaauauggaucucgacugccugaucccccaggagugggugcagcacuucuaccaagaagcugccccugcccagagcgauguggcucugcucagauuuguuaaccccgacaccggacggguccuguucgaguguaaacuucauaagucuggcuaugugacaguggcccacaccgggcagcacgaucuggucauuccucccaacggcuacuuuagauucgacagcugggugaaucaguucuauacgcucgcuccgaugggaaacggcgccgggcgccggagagcgcuguga

SEQ ID NO: 28582 - RNA, 1623 nt, Artificial Sequence
  derived and/or modified sequence opt5 from major_capsid_protein__Norovirus__AFU92713
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccugugcugaccgucgaggaaaugacaaacucuagauuuuccaucccccuugagaagcuguucaccgggccgagcucugccuucgugguucagccucagaauggacgguguacaaccgauggcgugcuccuggggacgacacaacugucccccgucaacauuugcaccuuucgcggagacgugacacauaucccuggcagcagaaauuacaccaugaaccucgccucccagaauuggaacucuuaugaucccaccgaggaaaucccugcuccccugggcacaccggacuucgucgggaaaauucagggagugcuuacgcagaccacacggaccaauggcagcacacgcgggcacaaggcgaccguuuacacgggauccgccgacuuuagcccuaagcugggcagagugcaauucgcuacagauaccgacaacgauuuugagaccaaucagaacacaaaauucacccccgucggggugauccaggacggaucuacaacgccccggaaugaaccucaacaguggguucucccguccuacagcggccgcaacauucauaaugugcaccuggcccccgccgucgcuccuaccuuucccggcgagcagcuucuguucuuuagaucuacaaugccuggguguagcggauaucccaacauggaucucgacugccugcugccucaggaaugggugcaauacuucuaucaggaggccgcgcccgcucaguccgauguggcccuccugcgguuuguuaauccggacaccggcagaguccuuuucgaguguaagcugcacaaaucuggguacgugacaguggcccauaccggacagcacgaucucgucaucccucccaacggcuauuuucgcuucgacagcugggugaaccaauucuacacgcuggcuccuauggggaauggcaccggacggagacgcgcccuuuga

SEQ ID NO: 28583 - RNA, 1623 nt, Artificial Sequence; identical to SEQ ID NO: 26522
  derived and/or modified sequence opt5 from major_capsid_protein__Norovirus__AFU92714

SEQ ID NO: 28584 - RNA, 1623 nt, Artificial Sequence
  derived and/or modified sequence opt5 from major_capsid_protein__Norovirus__AFU92715
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuuucuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcgcccuuuga

SEQ ID NO: 28585 - RNA, 1623 nt, Artificial Sequence
  derived and/or modified sequence opt5 from major_capsid_protein__Norovirus__AFU92717
augaagauggccagcuccgaccccaacccuucugauggcagcaccgcuaaucuggugccggaggucaacaaugaaguuauggcccucgagcccguggugggggcggcuaucgccgccccugucgcuggacagcaaaacgugauugaccccuggaucagaaauaacuucguucaggccccuggcggggaauuuacagugucuccccggaaugcuccuggagagauucugugguccgccccgcuuggccccgaucugaacccuuaccucagccaccuggcgcgcauguauaauggguacgccggaggcuucgaaguccaggugauccuugcuggcaacgccuuuacggcugggaaaauuaucuucgccgcgguucccccuaauuuucccaccgagggacuguccccgucucaggugacaauguucccucauaucauugucgacgugagacaacucgagcccgugcugaucccucugcccgauguccggaacaauuuuuaucacuacaaccagagcaaugacuccaagcucaaacugcgccccaugcuuuauaccccucugagagccaacaacgcuggcgaugacguuuucacagugagcugccgggugcucacccgcccgucucccgauuuugacuucauuuuucuggucccucccacaguggaauccagaaccaagccuuucagcguucccgugcuuacggucgaggaaaugaccaauucucgguuuccgaucccucuggagaaacucuucacagggcccuccagcgccuucgugguucagccucagaacggacgcuguaccacagauggcgugcugcuggggaccacgcaacucucucccgucaauauuugcacauuuagaggagacgugacccauaucccuggcucccggaacuacacaaugaaucuggcuagccagaacuggaacuccuaugaucccaccgaggaaauuccggccccucuuggcacccccgacuucgucgggaagauccagggagugcugacacagacgacccgcacaaauggcucuaccagagggcacaaggccacaguuuacaccggaagcgcugacuuuucccccaaacucggccgggugcaauucgcgacggauacagacaaugauuuugagaccaaccagaauaccaaguucacaccugucggggugauccaggacggaagcaccacaccgcgcaacgaaccccaacaguggguucugccuucuuacuccggcagaaauauucauaacgugcaccuugcccccgcugucgccccuacguuucccggcgagcagcuccuguucuuucggagcaccaugccuggguguucuggauaucccaauauggaucuggacugccugcucccgcaggaaugggugcaauacuucuaucaggaggccgcuccugcccagagcgauguggcgcugcuuagauuuguuaaccccgacacaggccgcguccuguucgaguguaaacuccacaaguccggguacgugaccguggcucauacaggacagcacgaucuggucaucccucccaacggcuauuuucgguucgacucuugggugaaucaauucuacacccuugccccgauggggaacggcacgggaagacgccgggcccuguga

SEQ ID NO: 28586 - RNA, 1623 nt, Artificial Sequence
  derived and/or modified sequence opt5 from major_capsid_protein__Norovirus__AFU92718
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuucccucgauuuugacuucauuuuucuggucccgcccaccguggaaagccgcacgaaaccuuucucuguucccgugcuuaccgucgaggaaaugacaaacuccagauuuccuaucccccuggagaagcuguucaccgggccgagcucugccuucgugguucagccucagaauggacgguguacaaccgauggcgugcugcuggggacgacacaacucucccccgucaacauuugcaccuuucgcggagacgugauccauaucccuggcagcagaaauuacacaaugaaccuggccucucagaauuggaacuccuaugaucccaccgaggaaauuccugcuccccuuggcaccccggacuucgucgggaaaauccagggagugcugacacagacgacccggacaaauggcagcacccgcgggcacaaggcgacaguuuacaccggauccgccgacuuuucuccuaagcucggcagagugcaauucgcuacggauacagacaacgauuuugagaccaaucagaacaccaaauucacacccgucggggugauucaggacggaagcaccacaccccggaaugaaccucaacaguggguucugccguccuacagcggccgcaacauccauaaugugcaccuugcccccgccgucgcuccuacguuucccggcgagcagcuccucuucuuuagaucuaccaugccuggguguuccggauaucccaacauggaucuggacugccugcucccucaggaaugggugcaauacuucuaucaggaggccgcgcccgcucagagcgauguggcccugcuucgguuuguuaacccggacacaggcagaguccuguucgaguguaagcuccacaaaucuggguacgugaccguggcccauacaggacagcacgaucuggucauuccucccaauggcuauuuucgcuucgacagcugggugaaccaauucuacacccuugcuccuauggggaauggcacgggacggagacgcgcccuguga

SEQ ID NO: 28587 - RNA, 1623 nt, Artificial Sequence; identical to SEQ ID NO: 27081
  derived and/or modified sequence opt5 from major_capsid_protein__Norovirus__AFU92719

SEQ ID NO: 28588 - RNA, 1623 nt, Artificial Sequence
  derived and/or modified sequence opt5 from major_capsid_protein__Norovirus__AFU92720
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugaucgacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucauugucgacgugagacaacucgagccugugcugaucccccugccugauguccggaauaacuuuuaucauuacaaucagagcaacgaccccaccauuaagcucaucgcuaugcuguauacaccccuucgcgccaauaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaacagcagauuucccaucccgcuugagaagcuguucaccgggccuucuuccgccuucgugguucagccccagaauggacgguguacaaccgauggcgugcuccuggggacgacacaacugagcccugucaacauuugcaccuuucgcggagacgugacacacauccccggcucuagaaauuacaccaugaaccucgccucccagaauuggaacagcuaugauccuaccgaggaaauccccgcuccgcugggcacaccugacuucgucgggaaaauucagggagugcuuacgcagaccacacggaccaauggcuccacacgcgggcauaaggcgaccguuuacacgggaucugccgacuuuagccccaagcugggcagagugcaauucgcuacagauaccgacaacgauuuugagaccaaucagaacacaaaauucacccccgucggggugauccaggacggauccacaacgccucggaaugaaccgcaacaguggguucuccccagcuacucuggccgcaacauucacaaugugcaccuggccccugccgucgcucccaccuuuccuggcgagcagcuucuguucuuuagauccacaaugcccggguguagcggauauccuaacauggaucucgacugccugcugccccaggaaugggugcaauacuucuaucaggaggccgcgccggcucagucugauguggcccuccugcgguuuguuaauccugacaccggcagaguccuuuucgaguguaagcugcauaaaagcggguacgugacaguggcccacaccggacagcaugaucucgucauucccccuaacggcuauuuucgcuucgacuccugggugaaccaauucuacacgcuggcucccauggggaauggcaccggacggagacgcgcccuuuga

SEQ ID NO: 28589 - RNA, 1623 nt, Artificial Sequence
  derived and/or modified sequence opt5 from major_capsid_protein__Norovirus__AFU92721
augaagauggccagcuccgacgcucaccccucugauggcagcaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacaguguccccucggaacgcccccggagagauucuguggucugcgccucuuggcccggaucugaaucccuaccucagccaucuggcccgcauguauaacggguacgcuggaggcuucgaaguccaggugauccuugccggcaaugcuuuuacggccgggaaaauuaucuucgcggccguuccucccaacuuuccuaccgagggacugucccccucucaggugacaauguucccgcacaucgucguggacgugagacaacucgagccuguccugauuccccugccugauguucggaauaacuuuuaucauuacaaucagagcaacgaccccaccaucaagcucauugcuaugcuguauacaccccuucgcgccaauaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaacagcagauuucccauuccgcuugagaagcuguucaccgggccuucuuccgccuucguugugcagccccagaauggacgguguacaaccgauggcguccuccuggggacgacacaacugagcccugugaacaucugcaccuuucgcggagacgucacacacauuucuggcuccagaaauuacaccaugaaccucgccagccagaauuggaacuccuaugaucccaccgaggaaaucccugcuccccugggcacaccggacuucguggggaaaauccagggaguucuuacgcagaccacacggaccgacggcucuacacgcgggcauaaggcgaccguguacacgggaagcgccgauuuuuccccuaagcugggcagaguccaauucgcuacagacaccgauaaugacuuugugaccaaccagaauacaaaauucacccccguuggggugauucaggauggaagcacaacgccccggaacgagccucaacaguggguccucccgucuuacuccggccgcaauacccacaacgugcaccuggcccccgccguggcuccuacauuucccggcgaacagcuucuguucuuuagaagcaccaugccuggguguucuggauaucccaauauggaccucgauugccugcugccucaggaguggguucaauacuucuaucaggaagccgcgcccgcucagagcgacgucgcccuccugcgguuugugaacccggauacaggcagagugcuuuucgaguguaagcugcauaaauccggguacgucaccguggcccacacgggacagcaugaccucguuaucccucccaauggcuauuuucgcuucgauucuugggugaaccaauucuacacccuggcuccuauggggaacggcacaggacggagacgcgcccuuuga

SEQ ID NO: 28590 - RNA, 1623 nt, Artificial Sequence
  derived and/or modified sequence opt5 from major_capsid_protein__Norovirus__AFU92722
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucauugugcagccccagaacggacgguguacaaccgauggcguucuccuggggacgacacaacugagcccugugaauaucugcaccuuucgcggagacgucacacauaucucuggcuccagaaacuacaccaugaaucucgccagccagaacuggaacuccuaugaucccaccgaggaaauuccugcuccccugggcacaccggacuucguggggaaaauccagggaguccuuacgcagaccacacggaccgacggcucuacacgcgggcacaaggcgaccguguacacgggaagcgccgauuuuuccccuaagcugggcagaguucaauucgcuacagacaccgauaaugacuuugugaccaaucagaacacaaaauucacccccgucggggugauucaggauggaagcacaacgccccggaaugagccucaacaguggguucucccgucuuacuccggccgcaacacccauaaugugcaccuggcccccgccgucgcuccuacauuucccggcgaacagcuucuguucuuuagaagcaccaugccuggguguucuggauaucccaacauggaccucgauugccugcugccucaggagugggugcaauacuucuaucaggaagccgcgcccgcucagagcgacguggcccuccugcgguuuguuaauccggauacaggcagaguccuuuucgaguguaagcugcacaaauccggguacgugaccguggcccauacgggacagcacgaccucgucaucccucccaacggcuauuuucgcuucgauucuugggugaaccaauucuacacccuggcuccuauggggaauggcacaggacggagacgcgcccuuuga

SEQ ID NO: 28591 - RNA, 1623 nt, Artificial Sequence
  derived and/or modified sequence opt5 from major_capsid_protein__Norovirus__AFU92723
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucgucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuguccugaccguggaggaaaugacaaauagcagauuucccauuccgcuugagaagcuguucaccgggccuucuuccgccuucguugugcagccccagaacggacgguguacaaccgauggcguccuccuggggacgacacaacugagcccugugaauaucugcaccuuucgcggagacgucacacauauuucuggcuccagaaacuacaccaugaaucucgccagccagaacuggaacuccuaugaucccaccgaggaaaucccugcuccccugggcacaccggacuucguggggaaaauccagggaguucuuacgcagaccacacggaccgacggcucuacacgcgggcacaaggcgaccguguacacgggaagcgccgauuuuuccccuaagcugggcagaguccaauucgcuacagacaccgauaaugacuuugugaccaaucagaacacaaaauucacccccguuggggugauucaggauggaagcacaacgccccggaaugagccucaacaguggguccucccgucuuacuccggccgcaacacccauaaugugcaccuggcccccgccguggcuccuacauuucccggcgaacagcuucuguucuuuagaagcaccaugccuggguguucuggauaucccaacauggaccucgauugccugcugccucaggaguggguucaauacuucuaucaggaagccgcgcccgcucagagcgacgucgcccuccugcgguuugugaauccggauacaggcagagugcuuuucgaguguaagcugcacaaauccggguacgucaccguggcccauacgggacagcacgaccucguuaucccucccaacggcuauuuucgcuucgauucuugggugaaccaauucuacacccuggcuccuauggggaauggcacaggacggagacgcgcccuuuga

SEQ ID NO: 28592 - RNA, 1647 nt, Artificial Sequence
  derived and/or modified sequence opt5 from major_capsid_protein__Norovirus__AGD79474
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugauagccggcugcgccuuauugccaugcuguacacaccccucagagccaauaacuccggggacgaugucuucaccgugucuugucgggugcugacccgcccuagccccgacuuuuccuucaauuuucuuguucccccuacagucgaaagcaagaccaaaccguucacgcugcccauccucaccauuucugagauguccaacagcagauuuccugugcccaucgauucucugcauacauccccuaccgaaaauaucgugguccagugccagaacggacgggugacacuggacggcgagcucauggggaccacgcaacugcuucccagccagauuugugcuuuccgcggaguucugacaagaucuaccucccgggcgagcgaucaggccgacacagcuaccccgcgccucuucaauuauuacuggcacauccagcuggacaaccuuaauggcaccccuuaugaucccgccgaggacauuccuggcccccuggggacaccugauuuuagaggaaagguguucggcgucgccucccaacggaaccccgacucuacgacccgcgcucaugaagccaaaguggauacaaccgcggggagauuuacaccgaagcucggaagccuggagaucuccaccgaaagcgacgauuucgaccagaaucagccuacgcgguuuacacccguuggcauugggguggauagagaggcugacuuccaacaguggucucugcccgauuacuccggacaguuuacccacaacaugaaucucgccccugccgucgcuccgaacuuccccggcgaacagcugcuguuuuuccgcagccaacuuccuucuagcggcgggcgguccaauggagugcucgacugccuggucccccaggagugggugcagcacuuuuaccaggagucugccccugcucaaacccagguugcccuugugagauaugucaaccccgacacaggccgcgugcuguucgaagcgaagcuccauaaacugggguuuaugaccaucgccaagaacggagauagcccuaucacaguucccccgaauggcuacuuccgguucgaguccugggugaacccuuuuuauacgcuggcucccauggggaccggcaauggaagacgccggguccaguga

SEQ ID NO: 28593 - RNA, 1647 nt, Artificial Sequence
  derived and/or modified sequence opt5 from major_capsid_protein__Norovirus__AGD79475
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuauucucccgaugccugacgugagaaacaauuucuuucacuauaaccagggcucugauagccggcugcgccuuaucgccaugcuguacacaccccucagagccaacaauuccggggacgaugucuucaccgugucuugucgggugcugacccgcccuagccccgacuuuuccuucaacuuucuuguucccccuacagucgaaagcaagaccaaaccguucacgcugcccauucucaccaucucugagauguccaauagcagauuuccugugcccaucgauucucugcauacauccccuaccgaaaacauugugguccagugccagaauggacgggugacacuggacggcgagcucauggggaccacgcaacugcuucccagccagaucugugcuuuccgcggaguucugacaagaucuaccucccgggcgagcgaucaggccgacacagugaccccgcgccucuucaacuauuacuggcacauucagcuggacaaucuuaacggcaccccuuaugaucccgcugaggacaucccuggcccccuggggacaccugauuuuagaggaaaggucuucggcguggccucccaacggaaucccgacucuacgacccgcgcccaugaagcuaaaguugauacaaccgccgggagauuuacaccgaagcucggaagccuggagauuuccaccgaaagcgacgauuucgaccagaaccagccuacgcgguuuacacccgugggcaucggggucgauagagaggcggacuuccaacaguggucucugcccgauuacuccggacaguuuacccacaauaugaaccucgcuccugccguggccccgaauuuccccggcgaacagcugcuguuuuuccgcagccaacuuccuucuagcggcgggcgguccaacggaauccucgacugccuggucccccaggagugggugcagcacuuuuaccaggagucugcuccugcccaaacccagguugcucuugugagauaugucaaucccgacacaggccgcgugcuguucgaagccaagcuccauaaacugggguuuaugaccauugcgaagaacggagauagcccuaucacaguucccccgaacggcuacuuccgguucgaguccugggugaauccuuuuuauacgcuggcccccauggggaccggcaacggaagacgccggauucaguga

SEQ ID NO: 28594 - RNA, 1647 nt, Artificial Sequence
  derived and/or modified sequence opt5 from major_capsid_protein__Norovirus__AGD79476
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgauaccacaacgcgcgcccaugaggcgaaaguggacaccacaagcgggagauuuaccccgaagcucggaucccuggaaaucagcacagagucugaugacuucgaucagaauaagccuacccgguuuacgcccguuggcauugggguggaccacgaagcugauuuccagcaauggacacugcccgacuacgccggacaguuuacccacaacaugaaucucgccccugcugucgugccgaacuuccccggcgagcagcugcuguuuuucagaucccagcuuccuagcucuggcgggcgcagcaauggaauccucgauugccuggucccccaagagugggugcagcauuuuuaccaggaauccgccccuucucagagccaaguugcucuugugcgguauaucaaccccgacaccggcagaguccuguucgaggccaaacuccacaagcugggguuuaugacaauugcgaaaaacggagacuccccuaucaccgugcccccgaauggcuacuuccgcuucgaaagcuggguuaacccuuuuuauacacuggcccccauggggacgggcaauggacggagacgcauucaguga

SEQ ID NO: 28595 - RNA, 1647 nt, Artificial Sequence
  derived and/or modified sequence opt5 from major_capsid_protein__Norovirus__AGD79477
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgauaccagcacacgcgcccaugaggcgaaaaucgacacgaccuccgggagauuuacaccgaagcucggaagccuggaaauuucuaccgaguccgaugacuucgaucagaauaagccuacacgguuuacccccgugggcaucgggguugaccacgaaacggauuuccagcaauggacacugcccgacuacgcuggacagcucacccacaacaugaaucuggccccugccguggcuccgaacuuucccggcgagcagcuucuguucuuuagaagccagcucccuucuagcggcgggcgcuccaauggaauccuggauugccuugucccccaagagugggugcagcauuucuaccaggaaucugccccuagccagucccaagucgcucuggugcgguauauuaaccccgacaccggcagaguucucuuugaggccaaacugcacaagcugggguucaugacaaucgcgaaaaacggagacagcccuauuaccgugcccccgaauggcuacuuucgcuucgaaucuugggucaacccuuucuauacacucgcccccauggggacgggcaauggacggagacgcauccaguga

SEQ ID NO: 28596 - RNA, 1647 nt, Artificial Sequence
  derived and/or modified sequence opt5 from major_capsid_protein__Norovirus__AGD79478
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaaugaaacaccuuaugaccccgccgagggcauuccuggcccccuggggaccccugauuuuagaggaaagguguucggcgucgcuucucaacggaaccccgacaccacaacgcgcgcccaugaagcgaaaguggauaccacaagcgggagauuuaccccgaagcucggaucccuggagaucagcacagaaucugacgauuucgaccagaauaagccuacccgguuuacgcccguuggcauugggguggaucacgaggcugacuuccagcaauggacacugcccgauuacgccggacaguuuacccacaacaugaaucucgccccugcugucgccccgaacuuccccggcgagcagcugcuguuuuucagaucccagcuuccuagcucuggcgggcgcagcaauggaauccucgacugccuggugccccaagaauggguccagcauuuuuaccaggaguccgcuccuucucagagccaaguggcccuuguucgguauaucaaccccgauaccggcagagugcuguucgaagcgaaacuccacaagcugggguuuauuacaaucgccaaaaacggagacuccccuauuaccgugcccccgaauggcuacuuccgcuucgagagcugggucaacccuuuuuauacacuggcucccauggggacgggcaauggacggagacgcauccaguga

SEQ ID NO: 28597 - RNA, 1647 nt, Artificial Sequence
  derived and/or modified sequence opt5 from major_capsid_protein__Norovirus__AGD79479
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuugugcguuccgcggaguucugaccagauccacgagccgggccuccgaccaggcugauacagccaccccgcgccucuucaauuauuacuggcacauccagcuggacaaccuuaauggcacaccuuaugaccccgccgaagauauuccuggcccccuggggaccccugacuuuagaggaaagguguucggcgucgcuucucaacggaaccccgauaccacaacgcgcgcccaugaggcgaaaguggacaccacaagcgggagauuuaccccgaagcucggaucccuggaaaucagcacagagucugaugacuucgaucagaauaagccuacccgguuuacgcccguuggcauugggguggaccacgaagcugauuuccagcaauggacacugcccgacuacgccggacaguuuacccacaacaugaaucucgccccugcugucgccccgaacuuccccggcgagcagcugcuguuuuucagaucccagcuuccuagcucuggcgggcgcaccaauggaauccucgauugccuggugccccaagaguggguccagcauuuuuaccaggaaagcgcuccuucccagucucaaguggcccuuguucgguauaucaaccccgacacaggcagagugcuguucgaggcgaaacuccacaagcugggguuuauuaccaucgccaaaaacggagacagcccuauuacagugcccccgaauggcuacuuccgcuucgaauccugggucaacccuuuuuauacgcuggcucccauggggaccggcaauggacggagacgcauccaguga

SEQ ID NO: 28598 - RNA, 1620 nt, Artificial Sequence
  derived and/or modified sequence opt5 from major_capsid_protein__Norovirus__AGH24750
augaagauggccagcaacgacaccauccccuccgauggcucuacagcuaaucuggugccugaggucaacaaugaaguuauggcccucgagccgguggugggggcggcuaucgccgcccccgucgcuggacagcaaaacgugaucgacccuuggauuagaaauaacuucguucaggcccccggcggggaauuuacggugagcccucggaaugcucccggagagauccugugguccaugccucuuucuccggaucugaaccccuaccucagccaccugucccgcauguauaauggcuacgccgggggauucgaaguccaggugauucuugcgggcaacgccuuuaccgcuggcaaaaucaucuucgccgcuauuccucccaauuuuccuacagacgggcugucucccagccagguuaccauguucccgcauaucauuguggaugucagacaacucgagccugugcugaucccccugccugacgugcggaacaauuuuuaucacuacaaccaggucaaugauuccacacucaagcugauugccaugcuuuauacaccccugcgcgcgaacaacgccggagacgauguuuucaccgugagcugcagagugcucacccggcccucuccugacuuugauuucaucuuucuggucccgcccacgguggagucccgcaccaaaccuuucacaguucccauucuuaccguggacgaaaugacaaauagcagauuuccuacgccccuggagcggcuccauaccggcccgaacaauucucuggucgugcagccucagaacgggcgcuguacaaucgauggaguucugcucggcaccacacaacuguccgcugugaauaucugcagcuucagaggggacucuaccacccgggaaggacagucccacgccuacacaaugaaccuugcuagccagaauuggacgaacuaugaccccaccgaggauauuccugcuccccugggcacaccugacuucgucggcaagaucguggggaugcucucccagaccacacgcgaaaauucuagcaccagagcccauaaagccacggucuccacaggagaugcgcacuuuaugcccaagcugggcagcgugcuuuucaccaccgacacagaggaucugcaaaacgggcagaauacccgguuuacaccgguuggaguggcccaggacggcgagccucaccaaaacgaaccccagcaguggcgccuccccaauuacucugggacgccuggacauaacguccaccuggcuccgcccguggccccuaccuuccccggcgagcagcugcucuuuuucagauccacaaugccuggcugugggggauaccccaauauggaucuggacugccuucugccucaagaauggguucggcauuuuuaucaggaggccgcucccgcccagagcgauguggcgcuccugagauucgucaacccggacaccggccgcgugcuuuuugaguguaagcugcacaaagcuggguacauuacagugucucacaccggaccuuaugaucucguuauucccccuaacggcuacuuccgguuugacagcugggucaaucaguucuaugcccuggcccccauggggacgggcaccggaagacgccgggcucuguga

SEQ ID NO: 28599 - RNA, 1623 nt, Artificial Sequence; identical to SEQ ID NO: 27022
  derived and/or modified sequence opt5 from major_capsid_protein__Norovirus__AGI37922

SEQ ID NO: 28600 - RNA, 1623 nt, Artificial Sequence
  derived and/or modified sequence opt5 from major_capsid_protein__Norovirus__AGM46344
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccgggccuagcucugccuucgucgugcagccccagaauggacgguguacaaccgauggcguucuccuggggacgacacaacuguccccugugaacaucugcaccuuucgcggagacgucacacauaucaccggcagcagaaauuacaccaugaaccucgccacacagaauuggaacucuuaugaucccacggaggaaauuccugcuccccugggcaccccggacuucguggggaaaauccagggaguccuuacacagaccacacgggcggacggcuccacccgcgggcacaaggccacgguguacacaggaagcgcugauuuugccccuaagcugggcagaguucaauucgccaccgacaccgauaaugacuuugaugcuaaccagaauacaaaauucacccccgugggggucauucaggacggagauacagcccaucggaacgagccccaacagugggugcucccuuccuacucuggccgcaauagccacaacguucaccuggcgccggcuguggcccccacguuuccuggcgaacagcuucuguucuuuagauccaccaugcccggguguagcggauauccuaauauggaccucgauugccugcugccccaggaguggguccaauacuucuaucaggaagccgcuccugcccagucugacguggcucuccugcgguuugugaaccccgauacaggcagaguucuuuucgaguguaagcugcauaaauccggguacgucaccguggcccacacaggacagcaugaccucgugaucccgccuaacggcuauuuucgcuucgacagcugggucaaucaauucuacacccuggcgcccauggggaacggcacgggacggagacgcgcccuuuga

SEQ ID NO: 28601 - RNA, 1623 nt, Artificial Sequence
  derived and/or modified sequence opt5 from major_capsid_protein__Norovirus__AGM46347
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaccgauggcguucuccuggggacgacacaacugagcccugugaauaucugcaccuuucgcggagacgucacacauaucaccggcucuagaaacuacaccaugaaucucgccacacagaacuggaacuccuaugaucccacggaggaaauuccugcuccccugggcaccccggacuucguggggaaaauccagggaguccuuacacagaccacacgggcggacggcagcacccgcgggcacaaggccacgguguacacaggauccgcugauuuuucuccuaagcugggcagaguucaauucgccaccgacaccgauaaugacuuugaugccaaucagaacacaaaauucacccccgugggggucauucaggacggagauacagcucaucggaaugagccccaacagugggugcucccuagcuacuccggccgcaacagccacaauguucaccuggccccggcgguggcucccacguuuccuggcgaacagcuucuguucuuuagaucuaccaugcccggguguuccggauauccuaacauggaccucgauugccugcugccccaggaguggguccaauacuucuaucaggaagccgccccugcucagagcgacguggcccuccugcgguuugugaaucccgauacaggcagaguucuuuucgaguguaagcugcauaaaucuggguacgucaccguggcucacacaggacagcaugaccucgugaucccgccuaacggcuauuuucgcuucgacagcugggucaaccaauucuacacccuggcccccauggggaauggcacgggacggagacgcgcgcuuuga

SEQ ID NO: 28602 - RNA, 1623 nt, Artificial Sequence; identical to SEQ ID NO: 26522
  derived and/or modified sequence opt5 from major_capsid_protein__Norovirus__AGM46349

SEQ ID NO: 28603 - RNA, 1623 nt, Artificial Sequence; identical to SEQ ID NO: 26522
  derived and/or modified sequence opt5 from major_capsid_protein__Norovirus__AGM46355

SEQ ID NO: 28604 - RNA, 1623 nt, Artificial Sequence
  derived and/or modified sequence opt5 from major_capsid_protein__Norovirus__AGM46359
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgaccccaccauuaagcucaucgcuaugcuguauacaccccuucgcgccaacaaugcuggcgaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccgggccuagcucugccuucgugguucagccccagaauggacgguguacaaccgauggcgugcuccuggggacgacacaacuguccccugucaacauuugcaccuuucgcggagacgugacacauaucucuagcuccagaaauuacaccaugaaccucgccagccagaauugguccucuuaugaucccaccgaggaaaucccugcuccccugggcacaccggacuucgucggcaaaauucagggggugcuuacgcagaccacacggaccgacggaagcacacgcggccacaaggcgaccguuuacacgggguccgccgauuuuagcccuaagcugggaagagugcaauucgacacagauaccgacaacgauuuugagaccaaucagaacacaaaauucacccccgucggcgugauccaggacgggucuacaacguaccggaaugaaccccaacaguggguucucccuuccuauagcggacgcaacacccauaaugugcaccuggcuccggccgucgcccccacauuuccuggcgagcagcuucuguucuuuagaucuaccaugcccggcuguagcggguacccuaacauggaucucgacugccugcugccccaggaaugggugcaauauuucuaccaggaggcugccccugcgcaguccgauguggcucuccugcgguuuguuaaucccgacacaggaagaguccuuuucgaguguaagcugcacaaaucuggcuaugugaccguggcccauacggggcagcacgaucucgucauuccgccuaacggauacuuucgcuucgacagcugggugaaccaauucuauacccuggcccccaugggcaaugggacaggccggagacgcgcucuuuga

SEQ ID NO: 28605 - RNA, 1623 nt, Artificial Sequence
  derived and/or modified sequence opt5 from major_capsid_protein__Norovirus__AGM46362
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucucuuccagcagaaacuacaccaugaaucucgccucccagaacuggucuagcuaugaucccaccgaggaaaucccugcuccccugggcacaccggacuucgucggcaaaauucagggggugcuuacgcagaccacacggaccgacggauccacacgcggccacaaggcgaccguuuacacggggagcgccgauuuuucuccuaagcugggaagagugcaauucgacacagauaccgacaaugauuuugagaccaaccagaauacaaaauucacccccgucggcgugauccaggacggguccacaacguaccggaacgaaccccaacaguggguucucccuagcuauucuggacgcaauacccauaacgugcaccuggcuccggccgucgcccccacauuuccuggcgagcagcuucuguucuuuagaagcaccaugcccggcuguuccggguacccuaauauggaucucgacugccugcugccccaggaaugggugcaauauuucuaccaggaggcugccccugcgcagucugauguggcucuccugcgguuuguuaaccccgacacaggaagaguccuuuucgaguguaagcugcacaaaagcggcuaugugaccguggcccauacggggcagcacgaucucgucauuccgccuaauggauacuuucgcuucgacuccugggugaaccaauucuauacccuggcccccaugggcaacgggacaggccggagacgcgcucuuuga

SEQ ID NO: 28606 - RNA, 1623 nt, Artificial Sequence
  derived and/or modified sequence opt5 from major_capsid_protein__Norovirus__AGM46366
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccugugcugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauauccccggcucuagaaacuacaccaugaaucucgccucccagaacuggaauagcuaugauccuaccgaggaaauccccgcuccgcugggcacaccugacuucgucgggaaaauucagggagugcuuacgcagaccacacggaccaacggcuccacacgcgggcacaaggcgaccguuuacacgggaucugccgacuuuagccccaagcugggcagagugcaauucgcuacagauaccgacaaugauuuugagaccaaccagaauacaaaauucacccccgucggggugauccaggacggauccacaacgccucggaacgaaccgcaacaguggguucuccccagcuacucuggccgcaauauucauaacgugcaccuggccccugccgucgcucccaccuuuccuggcgagcagcuucuguucuuuagauccacaaugcccggguguagcggauauccuaauauggaucucgacugccugcugccccaggaaugggugcaauacuucuaucaggaggccgcgccggcucagucugauguggcccuccugcgguuuguuaacccugacaccggcagaguccuuuucgaguguaagcugcacaaaagcggguacgugacaguggcccauaccggacagcacgaucucgucauucccccuaacggcuauuuucgcuucgacuccugggugaaucaauucuacacgcuggcucccauggggaacggcaccggaucucggagagcccuuuga

SEQ ID NO: 28607 - RNA, 1623 nt, Artificial Sequence; identical to SEQ ID NO: 26522
  derived and/or modified sequence opt5 from major_capsid_protein__Norovirus__AGM46367

SEQ ID NO: 28608 - RNA, 1623 nt, Artificial Sequence
  derived and/or modified sequence opt5 from major_capsid_protein__Norovirus__AGM46370
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugguucuugccggcaacgcuuuuacggccgggaaaaucauuuucgcggccgugccucccaauuuuccuaccgagggacugucccccucucaggucacaauguucccgcauaucaucguggacgugagacaacucgagccuguccugauuccccugccugauguucggaacaauuuuuaucacuacaaccagagcaaugaccccaccaucaagcucauugcuaugcuguauacaccccuucgcgccaacaacgcuggcgaugacguguucaccguguccugcagaguccugacacggccuagcccggauuuugacuucaucuuucucgugcccccuaccguugaaucucgcacgaaacccuucuccgugccuauucugaccgucgaggaaaugacaaauagcagauuucccaucccgcuugagaagcuguucaccgggccuucuuccgccuucgugguucagccccagaacggacgguguacaaccgauggcgugcuccuggggacgacacaacugagcccugucaauauuugcaccuuucgcggagacgugacacauaucaccggcucuagaaacuacaccaugaaucucgccacacagaacuggaacuccuaugaucccacggaggaaaucccugcuccccugggcaccccggacuucgucgggaaaauucagggagugcuuacacagaccacacgggcggacggcagcacccgcgggcacaaggccacgguuuacacaggauccgcugauuuugccccuaagcugggcagagugcaauucgccaccgacaccgauaaugacuuugaugcuaaucagaacacaaaauucacccccgucggggugauccaggacggagauacagcccaucggaaugagccccaacaguggguucucccuucuuacagcggccgcaacucccacaaugugcaccuggcgccggcugucgcccccacguuuccuggcgaacagcuucuguucuuuagaagcaccaugcccggguguucuggauauccuaacauggaccucgauugccugcugccccaggagugggugcaauacuucuaucaggaagccgcuccugcccaguccgacguggcucuccugcgguuuguuaaucccgauacaggcagaguccuuuucgaguguaagcugcauaaaagcggguacgugaccguggcccacacaggacagcaugaccucgucauuccgccuaacggcuauuuucgcuucgacucuugggugaaccaauucuacacccuggcgcccauggggaauggcacgggacggagacgcgcccuuuga

SEQ ID NO: 28609 - RNA, 1623 nt, Artificial Sequence; identical to SEQ ID NO: 28608
  derived and/or modified sequence opt5 from major_capsid_protein__Norovirus__AGM46375

SEQ ID NO: 28610 - RNA, 1623 nt, Artificial Sequence
  derived and/or modified sequence opt5 from major_capsid_protein__Norovirus__AGM46377
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacgucacccauaucacaggcucuagaaacuacaccaugaaucucgcuacccagaacuggaacuccuaugaucccacagaggaaauuccugcgccccugggcacgccggacuucguggggaaaauccagggaguccuuacccagacaacccgggccgacggcagcacacgcgggcacaaggcuaccguguacacgggauccgccgauuuugccccuaagcugggcagaguucaauucgcuacagacaccgauaaugacuuugaugccaaucagaacaccaaauucacacccgugggggucauucaggacggagauaccgcgcaucggaaugagccccaacagugggugcucccuucuuacagcggccgcaacucccacaauguucaccuggcuccggccguggcccccacauuuccuggcgaacagcuucuguucuuuagaagcacgaugcccggguguucuggauauccuaacauggaccucgauugccugcugccccaggaguggguccaauacuucuaucaggaagcugccccugcucaguccgacguggcccuccugcgguuugugaaucccgauaccggcagaguucuuuucgaguguaagcugcauaaaagcggguacgucacaguggcgcacaccggacagcaugaccucgugaucccgccuaacggcuauuuucgcuucgacucuugggucaaccaauucuacacacuggcccccauggggaauggcaccggacggagacgcgcucuuuga

SEQ ID NO: 28611 - RNA, 1623 nt, Artificial Sequence; identical to SEQ ID NO: 28608
  derived and/or modified sequence opt5 from major_capsid_protein__Norovirus__AGM46379

SEQ ID NO: 28612 - RNA, 1623 nt, Artificial Sequence; identical to SEQ ID NO: 28608
  derived and/or modified sequence opt5 from major_capsid_protein__Norovirus__AGM46384

SEQ ID NO: 28613 - RNA, 1623 nt, Artificial Sequence
  derived and/or modified sequence opt5 from major_capsid_protein__Norovirus__AGM46386
augaagaugggcagcaacgacgccaaucccuccgaugggucuaccgcuaaccuggugccugaggucaauaacgaaguuauggcccucgagccgguggugggagcggcuaucgccgcccccgucgcuggccagcaaaaugugaucgacccuuggaucagaaacaauuucguucaggcccccgggggagaauuuacagugagcccucggaacgcucccggcgagauucugugguccgccccucuugggccggaucugaaucccuaccucucucaccuggcgcgcauguauaacggauacgccggcggcuucgaaguccaggugauccuugcugggaaugccuuuacggcuggaaaaauuaucuucgccgcgguuccucccaacuuuccuaccgagggccugagccccucccaggugacaauguucccgcauaucauugucgacgugagacaacucgagccugugcugaucccccugccugauguccggaauaacuuuuaucacuacaaucagucuaacgaccccaccauuaagcucaucgccaugcuguauacaccccuucgcgcuaacaaugccggggaugacguuuucaccgugagcugcagagugcugacacggccuuccccggauuuugacuucauuuuucucgugcccccuaccgucgaaagccgcacgaaacccuucucuguuccugugcugaccgucgaggaaaugacaaacuccagauuucccaucccgcuugagaagcuguucaccggaccuagcucugcuuucgugguucagccccagaauggccgguguacaaccgauggggugcuccugggaacgacacaacuguccccugucaacauuugcaccuuucgcggcgacgugacacauauccccggcagcagaaauuacaccaugaaccucgccucucagaauuggaacuccuaugauccuaccgaggaaauccccgccccgcuggggacaccugacuucgucggaaaaauucagggcgugcuuacgcagaccacacggaccaaugggagcacacgcggacacaaggcuaccguuuacacgggcuccgcggacuuuucucccaagcuggggagagugcaauucgccacagauaccgacaacgauuuugagaccaaucagaacacaaaauucacccccgucggagugauccaggacggcagcacaacgccucggaaugaaccgcaacaguggguucuccccuccuacagcggccgcaacauucauaaugugcaccuggcuccugccgucgcccccaccuuuccuggggagcagcuucuguucuuuagaucuacaaugcccggauguuccggcuauccuaacauggaucucgacugccugcugccccaggaaugggugcaauacuucuaucaggaggcugccccggcgcagagcgauguggcucuccugcgguuuguuaacccugacaccgggagaguccuuuucgaguguaagcugcacaaaucuggauacgugacaguggcccauaccggccagcacgaucucgucauucccccuaauggguauuuucgcuucgacagcugggugaaccaauucuacacgcuggcccccaugggcaauggaaccggccggagacgcgcucuuuga

SEQ ID NO: 28614 - RNA, 1623 nt, Artificial Sequence
  derived and/or modified sequence opt5 from major_capsid_protein__Norovirus__AGM46388
augaagaugggcagcaacgacgccaaucccuccgaugggucuaccgcuaaccuggugccugaggucaauaacgaaguuauggcccucgagccgguggugggagcggcuaucgccgcccccgucgcuggccagcaaaaugugauugacccuuggaucagaaacaauuucguucaggcccccgggggagaauuuacagugagcccucggaacgcucccggcgagauucugugguccgccccucuugggccggaucugaaucccuaccucucucaccuggcgcgcauguauaacggauacgccggcggcuucgaaguccaggugauccuugcugggaaugccuuuacggcuggaaaaauuaucuucgccgcgguuccucccaacuuuccuaccgagggccugagccccucccaggugacaauguucccgcauaucauugucgacgugagacaacucgagccugugcugaucccccugccugauguccggaauaacuuuuaucacuacaaucagucuaacgaccccaccauuaagcucaucgccaugcuguauacaccccuucgcgcuaacaaugccggggaugacguuuucaccgugagcugcagagugcugacacggccuuccccggauuuugacuucauuuuucucgugcccccuaccgucgaaagccgcacgaaacccuucucuguuccuauccugaccguggaggaaaugacaaacuccagauuucccauuccgcuugagaagcuguucaccggaccuagcucugcuuucgucgugcagccccagaauggccgguguacaaccgaugggguucuccugggaacgacacaacuguccccugugaacaucugcaccuuucgcggcgacgucacacauaucaccggcagcagaaauuacaccaugaaccucgccacacagaauuggaacucuuaugaucccacggaggaaauuccugcuccccuggggaccccggacuucgugggaaaaauccagggcguccuuacacagaccacacgggccgacggguccacccgcggacacaaggcgacgguguacacaggcagcgccgauuuugcuccuaagcuggggagaguucaauucgccaccgacaccgauaaugacuuugaugccaaccagaauacaaaauucacccccgugggagucauucaggacggcgauacagcucaucggaacgagccccaacagugggugcucccuuccuacucuggccgcaauagccacaacguucaccuggccccggcgguggcucccacguuuccuggggaacagcuucuguucuuuagauccaccaugcccggauguagcggcuauccuaauauggaccucgauugccugcugccccaggaguggguccaauacuucuaucaggaagccgccccugcucagucugacguggcccuccugcgguuugugaaccccgauacagggagaguucuuuucgaguguaagcugcauaaauccggauacgucaccguggcucacacaggccagcaugaccucgugaucccgccuaacggguauuuucgcuucgacagcugggucaaucaauucuacacccuggcccccaugggcaacggaacgggccggagacgcgcgcuuuga

SEQ ID NO: 28615 - RNA, 1623 nt, Artificial Sequence
  derived and/or modified sequence opt5 from major_capsid_protein__Norovirus__AGM46392
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugaccccaccauuaagcucaucgcuaugcuguauacaccccuucgcgccaacaacgcuggcgaugacguuuucaccguguccugcagagugcugacacggccuagcccggauuuugacuucauuuuucucgugcccccuaccgucgaaucucgcacgaaacccuucuccguuccuauccugaccguggaggaaaugacaaauagcagauuucccauuccgcuugagaagcuguucaccgggccuucuuccgccuucgucgugcagccccagaacggacgguguacaaucgauggcguucuccuggggaccacgcaacugagcccugugaauaucugcacauuucgcggagacgucacccauauuacaggcucuagaaacuacaccaugaaucucgccacccagaacuggaacuccuaugaucccacagaggaaaucccugcuccccugggcacgccggacuucguggggaaaauucagggaguccuuacccagacaacccgggcggacggcagcacacgcgggcacaaggccaccguguacacgggauccgcugauuuugccccuaagcugggcagaguucaauucgccacagacaccgauaaugacuuugaugcuaaucagaacaccaaauucacacccgugggggucauccaggacggaaauaccgcccaucggaacgagccccaacagugggugcucccuucuuacagcggccgcaauucccacaacguucaccuggcgccggcuguggcccccacauuuccuggcgaacaguuccuguuuuucagaagcacgaugcccggguguucuggauauccuaauauggaucuugacugccuccugccccaggaguggguccaauacuuuuaucaggaagccgcuccugcccaguccgauguggcucugcuccgguucgugaaccccgacaccggcagaguucuguuugaguguaaacuucauaagagcggguacgucacaguggcccacaccggacagcaugaucuggugauuccgccuaacggcuauuuccgcuucgacucuugggucaaucaauuuuacacacucgcgcccauggggaacggcaccggacggagacgcgcccuguga

SEQ ID NO: 28616 - RNA, 1623 nt, Artificial Sequence; identical to SEQ ID NO: 27022
  derived and/or modified sequence opt5 from major_capsid_protein__Norovirus__AGM46395

SEQ ID NO: 28617 - RNA, 1623 nt, Artificial Sequence
  derived and/or modified sequence opt5 from major_capsid_protein__Norovirus__AGM46398
augaagauggccagcuccgacgcuaaccccucugauggcagcaaagccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuaccguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacagccgggaagauuaucuucgcggccguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaaacucaucgcuaugcuguauacaccccuucgcgccaacaacgcuggcgaugacguuuucaccguguccugcagagugcugacccggccuagcccggauuuugacuucauuuuucucgugcccccuacagucgaaucucgcaccaagcccuucuccguuccugugcugacggucgaggaaaugaccaauagcagauuucccaucccgcuugagaaacuguucacagggccuucuuccgccuucgugguucagccccagaacggacgguguaccacagauggcgugcuccuggggaccacgcaacugagcccugucaauauuugcacauuucgcggagacgugacccauauccccggcucuagaaacuacacaaugaaucucgccucccagaacuggaauagcuaugauccuaccgaggaaauccccgcuccgcugggcaccccugacuucgucgggaagauucagggagugcuuacacagacgacccggacaaacggcuccacccgcgggcacaaggcgacaguuuacaccggaucugccgacuuuagccccaaacugggcagagugcaauucgcuacggauacagacaaugauuuugagaccaaccagaauaccaaguucacacccgucggggugauccaggacggauccaccacaccucggaacgaaccgcaacaguggguucuccccagcuacucuggccgcaauauucauaacgugcaccuggccccugccgucgcucccacguuuccuggcgagcagcuucuguucuuuagauccaccaugcccggguguagcggauauccuaauauggaucucgacugccugcugccccaggaaugggugcaauacuucuaucaggaggccgcgccggcucagucugauguggcccuccugcgguuuguuaacccugacacaggcagaguccuuuucgaguguaaacugcacaagagcggguacgugaccguggcccauacaggacagcacgaucucgucauucccccuaacggcuauuuucgcuucgacuccugggugaaucaauucuacacccuggcucccauggggaacggcacgggaucucggagagcccuuuga

SEQ ID NO: 28618 - RNA, 1623 nt, Artificial Sequence; identical to SEQ ID NO: 26522
  derived and/or modified sequence opt5 from major_capsid_protein__Norovirus__AGM46401

SEQ ID NO: 28619 - RNA, 1623 nt, Artificial Sequence; identical to SEQ ID NO: 26522
  derived and/or modified sequence opt5 from major_capsid_protein__Norovirus__AGM46403

SEQ ID NO: 28620 - RNA, 1623 nt, Artificial Sequence
  derived and/or modified sequence opt5 from major_capsid_protein__Norovirus__AGM46407
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgagccuuggcccugaucugaacccguaccucucccaccuggcccgcauguauaauggguacgcuggaggcuucgaaguccaggugauccuugccggcaacgcuuuuacggccgggaaaauuaucuucgcggccguucccccuaauuuucccaccgagggacugucuccuagccaggugacaauguucccccauaucauugucgacgugagacaacucgagccggugcugaucccucugcccgauguccggaacaauuuuuaucacuacaaccaguccaaugacccuaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucccuggcuccagaaacuacaccaugaaucucgccagccagaacuggaacuccuaugaucccaccgaggaaaucccugcuccccugggcacaccggacuucgucgggaaaauucagggagugcuuacgcagaccacacggaccaauggcucuacacgcgggcacaaggcgaccguuuacacgggaagcgccgacuuuuccccuaagcugggcagagugcaauucgcuacagauaccgacaaugauuuugagaccaaccagaauacaaaauucacccccgucggggugauccaggacggaagcacaacgccccggaacgaaccucaacaguggguucucccgucuuacuccggccgcaauauucauaacgugcaccuggcccccgccgucgcuccuaccuuucccggcgagcagcuucuguucuuuagaagcacaaugccuggguguucuggauaucccaauauggaucucgacugccugcugccucaggaaugggugcaauacuucuaucaggaggccgcgcccgcucagagcgauguggcccuccugcgguuuguuaacccggacaccggcagaguccuuuucgaguguaagcugcacaaauccggguacgugacaguggcccauaccggacagcacgaucucgucaucccucccaacggcuauuuucgcuucgacucuugggugaaucaauucuacacgcuggcuccuauggggaacggcaccggacggagacgcgcccuuuga

SEQ ID NO: 28621 - RNA, 1623 nt, Artificial Sequence
  derived and/or modified sequence opt5 from major_capsid_protein__Norovirus__AGM46409
augaagauggccagcaacgacgcuaaucccuccgauggcucuaccgccaaccuggugccugaggucaauaacgaaguuauggcgcucgagccgguggugggggcugccaucgccgcucccgucgccggacagcaaaaugugauugacccuuggaucagaaacaauuucguucaggcucccggcggggaauuuacagugagcccucggaacgcccccggagagauucugugguccgcgccucuuggcccggaucugaaucccuaccucucucaccuggcccgcauguauaacggguacgcuggaggcuucgaaguccaggugauccuugccggcaaugcuuuuacggccgggaaaauuaucuucgcggccguuccucccaacuuuccuaccgagggacugagccccucccaggugacaauguucccgcauaucauugucgacgugagacaacucgagccugugcugaucccccugccugauguccggaauaacuuuuaucacuacaaucagucuaacgacagcaccauuaagcucaucgcuaugcuguauacaccccuucgcgccaacaaugcuggcgaagauguuuucaccguguccugcagagugcugacacggcccagcccugacuuugauuucauuuuucucgucccgcccaccguggagucucgcacgaaaccuuucaccguucccauccugacaguggaagagaugaccaacuccagauuuccuauuccccuugagaagcuguucacagggccgagcucugccuucgucgugcagccucagaauggacgguguaccacggacggcguucuccuggggacaacccaacugucccccgugaacaucugcacauuucgcggagaugucacccauaucgccggcagcagaaauuacaccaugaaccucgcuucucugaauuggaacaauuaugacccuacagaagagauucccgcgccucuuggcacgcccgauuucguggggaaaauccagggaguccugacccagacaaccaagggcgacggguccacacggggacacaaggccaccguguacacgggcagcgcuccguuuacaccuaaacucggguccguucaguucucuaccgacaccgaaaacgauuuugagacacaucaaaauaccaaguucacacccgugggagucauucaggacggcggcacgacccaccgcaacgaaccccagcaaugggugcugccuagcuacuccgggagaaauguucagaacgugcaccuugccccggccgucgcucccacauuuccuggagagcagcuccuguucuuucggagcaccaugcccggcuguucuggguauccuaauauggaucuggacugccugcucccccaggagugggugcaacauuucuaccaggaagccgcgccugcucaguccgauguggcccugcuucgcuuuguuaaccccgacacaggaagaguccuguucgaguguaaacuccacaagagcggcuaugugaccguggcccauacggggcagcacgaucuggucaucccgccuaacggcuacuuucgguucgacucuugggugaaucaauucuauacccuugcucccaugggaaacggcacagggagacgccgggcccuguga

SEQ ID NO: 28622 - RNA, 1623 nt, Artificial Sequence; identical to SEQ ID NO: 27642
  derived and/or modified sequence opt5 from major_capsid_protein__Norovirus__AGM46413

SEQ ID NO: 28623 - RNA, 1623 nt, Artificial Sequence
  derived and/or modified sequence opt5 from major_capsid_protein__Norovirus__AGM46415
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucucacaacuacaccaugaaucucgcgucccugaacuggaauaacuaugacccuaccgaagagauucccgccccucuuggcacacccgauuucguggggaaaauccagggaguccugacgcagaccacaaagggcgacgggagcaccagaggacauaaggcuacaguguacaccggcuccgccccguuuacgccuaaacucgggucuguucaguucagcacagacaccgaaaaugauuuugagacccaccaaaacacaaaguucacccccgugggagucauucaggacggcggcacaacgcaccggaaugaaccccagcaaugggugcugccuuccuacagcgggcgcaacguuccgaaugugcaucuugcccccgcugucgccccuaccuuucccggagagcagcuccuguucuuuagaucuacaaugccuggcuguuccggguaucccaacauggaucuggacugccugcucccucaggagugggugcagcacuucuaccaagaagcggcucccgcccagagcgauguggcccugcuucgguuuguuaauccggacaccggacgcguccuguucgaguguaaacuccauaagucuggcuaugugacaguggcucacaccgggcagcacgaucuggucaucccucccaacggcuacuuuagauucgacagcugggugaaccaguucuauacgcuugccccuaugggaaauggcaccgggcggagacgcgcucuguga

SEQ ID NO: 28624 - RNA, 1623 nt, Artificial Sequence
  derived and/or modified sequence opt5 from major_capsid_protein__Norovirus__AGM46419
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuggagccuucgucgugcagccucagaacggccgguguacaaccgacgggguucuccugggaacgacacaacugucccccgugaauaucugcaccuuucgcggcgaugucacacauaucgcuggcagcagaaacuacaccaugaaucucgcgucucugaacuggaauaacuaugacccuaccgaagagauucccgccccucuugggauccccgauuucgugggaaaaauucagggcguccugacacagacgaccaagggggacggauccacacggggccacaaggcuaccguguacacagggagcgccccguuuaccccuaaacucggauccguucaguucucuacggacacagaaaaugauuuugagacccaucaaaacaccaaguucacacccgugggcgucauccaggacggcgggaccacacaccgcaaugaaccccagcaaugggugcugccuagcuacuccggaagaaacguucagaaugugcaccuugccccggcugucgcccccacguuuccuggcgagcagcuccuguucuuucggagcaccaugcccggguguucuggauauccuaacauggaucuggacugccugcucccccaggagugggugcaacauuucuaccaggaagcggcuccugcccaguccgauguggcccugcuucgcuuuguuaaucccgacacaggcagaguccuguucgaguguaaacuccacaagagcggguaugugaccguggcucauacaggccagcacgaucuggucauuccgccuaacggauacuuucgguucgacucuugggugaaccaauucuauacccuugcccccaugggcaaugggacgggaagacgccgggcucuguga

SEQ ID NO: 28625 - RNA, 1623 nt, Artificial Sequence
  derived and/or modified sequence opt5 from major_capsid_protein__Norovirus__AGM46421
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagagacuacaccaugaaccucgcgucccugaauuggaacaauuaugauccuaccgaagagauucccgccccucuuggcacacccgacuucguggggaaaauccagggaguccugacgcagaccacaaagggcgacgggagcacccggggacacaaggcuacaguguacaccggcuccacgccguuuacaccuaaacucgggucuguucaguucagcaccgauaccgaaaacgacuuugagacacaucaaaauaccaaguucacacccgugggagucauucaggauggcggcacgacccaccgcaacgaaccccagcaaugggugcugccuuccuacagcgggagaaauguucagaacgugcaccuugccccggccgucgcucccacauuuccuggagagcagcuccuguucuuucggucuaccaugcccggcuguuccggguauccuaauauggaccuggauugccugcucccccaggagugggugcaacauuucuaccaggaagccgcgccugcucagagcgacguggcccugcuucgcuuuguuaaccccgauacaggaagaguccuguucgaguguaaacuccacaagucuggcuaugugaccguggcccauacggggcagcacgaccuggucaucccgccuaauggcuacuuucgguucgauagcugggugaaccaauucuauacccuugcucccaugggaaacggcacagggagacgccgggcccuguga

SEQ ID NO: 28626 - RNA, 1623 nt, Artificial Sequence
  derived and/or modified sequence opt5 from major_capsid_protein__Norovirus__AGM46425
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugagccccgugaauaucugcaccuuucgcggagaugucacacauaucgcuggcucuagaguguacaccaugaaccucgcgucccugaauuggaacaauuaugacccuaccgaagagauucccgccccucuuggcacacccgauuucgucgggaaaauccagggagugcugacgcagaccacaaaggaagacggcagcacccgggggcacaaggcuacaguuuacaccggauccgccccguuuacgccuaaacucggcucugugcaguucagcacagacaccgagaacgauuuugaaacccaucaaaauacaaaguucacccccgucggggugauucaggacggaggcacaacgcaccgcaacgagccccagcaauggguucugccuuccuacagcggcagaaaugccccgaacgugcaccuugcucccgccgucgcgccuaccuuucccggggagcagcuccuguucuuucggucuacaaugccuggauguuccggcuaucccaauauggaucuggacugccugcucccucaggaaugggugcagcauuucuaccaagaggcugcccccgcccagagcgauguggcucugcuucgcuuuguuaacccggacaccgggagaguccuguucgaauguaaacuccacaagucuggauaugugacaguggcccauaccggccagcacgaucuggucaucccucccaauggguacuuucgguucgacagcugggugaaccaguucuauacgcuugcuccuaugggcaacggaaccggcagacgccgggcccuguga

SEQ ID NO: 28627 - RNA, 1623 nt, Artificial Sequence
  derived and/or modified sequence opt5 from major_capsid_protein__Norovirus__AGM46427
augaagauggccagcaacgacgcuucccccucugauggcagcgccgcgaaucuggugccugaggucaacaaugaaguuauggcucucgagccgguggugggggccgccaucgcugcccccgucgcuggacagcaaaacgugaucgacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugacuccacaauuaagcucaucgccaugcuguauacaccccuucgcgcuaacaacgccggcgaagauguuuucaccgugagcugcagagugcugacccggcccucuccugacuuugauuucauuuuucucgucccgcccacaguggagucccgcaccaaaccuuucacgguucccauccugaccguggaagagaugacaaauagcagauuuccuauuccccuugagaagcuguucaccgggccgucuuccgccuucgucgugcagccucagaacggacgguguacaaccgacggcguucuccuggggacgacacaacugcccccugugaauaucugcaccuuucgcggagaugucacacauaucgcuggcagcagaguguacaccaugaaccucgcgucucugaauuggaacaauuaugaccccaccgaagagauuccugcuccccuuggcacaccggauuucgucgggaaaauccagggagugcugacgcagaccacaaaggaagacggcuccacccgggggcacaaggccacaguuuacaccggaagcgccccuuuuacgcccaaacucggcuccgugcaguucucuacagacaccgagaacgauuuugaaacccaucaaaauacaaaguucacccccgucggggugauucaggacggaggcacaacgcaccgcaacgagccucagcaauggguucugccgagcuacuccggcagaaaugcccccaacgugcaccuugcuccugccgucgcgcccaccuuuccuggggagcagcuccuguucuuucggagcacaaugcccggauguucuggcuauccuaauauggaucuggacugccugcucccccaggaaugggugcagcauuucuaccaagaggcugccccggcccaguccgauguggcucugcuucgcuuuguuaacccugacaccgggagaguccuguucgaauguaaacuccacaagagcggauaugugacaguggcccauaccggccagcacgaucuggucauucccccuaauggguacuuucgguucgacucuugggugaaccaguucuauacgcuugcucccaugggcaacggaaccggcagacgccgggcccuguga

SEQ ID NO: 28628 - RNA, 1623 nt, Artificial Sequence; identical to SEQ ID NO: 27746
  derived and/or modified sequence opt5 from major_capsid_protein__Norovirus__AGM46431

SEQ ID NO: 28629 - RNA, 1671 nt, Artificial Sequence
  derived and/or modified sequence opt5 from major_capsid_protein__Norovirus__AGN11430
augaagauggccagcuccgacgcugcccccucuaccgauggcgcggggaaccuggugccugagagccagcaagaaguccucccgcuggcucccguugccggagccgcucuugccgcuccuguggugggccagacaaauaucauugaccccuggaucaaggagaacuucguccaggccccucagggggaauuuacggugucccccaagaacucuccuggagagauucugguuaaucucgaacugggcccgaaacuuaaucccuaccuggaucaccucagcagaauguauaacuccuacgccgggggaaucgacgugauggucgugcuggccggcaaugcuuucaccgccggcaagguucugauugcugccaucccucccaacuuuccuguggaggucgugucugcgagccaagccacacaguucccccaugugaucauugauguccggacccucgacccgguucgccugccucuucccgaugugagauccacauuuuuccacuauaccaaugacacagagccuaaaaugcggcuggugaucuggcucuacacgccccugcgcaccaacgggagcggagaugacucuuuuaccgucuccggccggauucuuacaagacccagccaggauuucgaauuugcuuuccugaucccuccgaccguggagacaaagaccacgcccuuuucuguuccuggguucuccgugcaggaaaugagcaauucucgcuggcccgccgcuauuuccgccauggucgugagaggaaacgagccucaaguugugcaguuucagaauggccgggcccaucucgacgggaugcugcugggaacaacccccgucagcccgaacuauaucgcuuccuaccgcggcauuucuacaggcaauagcagauccgcgagcccugaggccgaugaacgggcuguggggucuuucgacgucugggugcgccuccaggagcccgacggacaaccuuaugauaucuucggcaagcagcccgccccuaucgggacccccgacuuuaaagccguuauugugggauucgcugccagaccgcugaccuccggcagcuacgcgaacgaagccuacgucaacacaacggcuucuaauuaugccccugcuaccgggaacaugcgguuuacagugcgcaauggaggcaccggccacacaagcgccaacaaguacugggaguucaaauccuuugggguugaaggagagagacauaccggcauccaguaucaagaguacgaacuucccgauuauucuggacagguggcuagcaaucacaaccuggcgcccccugucgcgccgcggaugcccggggagucccuccugcuuuuccagagcaauaugccugugugggacgauggccacggggaaucuacgcccaagaaaauucauugccugcucccucaggaguuuaucggccacuucuuugacaagcaagcccccucccugggagaugcugcccugcucagauacgugaaccaggaaacaaaucgcguucuguucgaguguaaacuuuaucgggacggcuacauuaccgucgcugccagcucugggcugcucgauuuuccucuggacggauucuuuagauucgauuccugggugagcuccuucuacauccuuucucccgugggcagcgggcagggacgccggggcagaguccgcuuucaguga

SEQ ID NO: 28630 - RNA, 1647 nt, Artificial Sequence
  derived and/or modified sequence opt5 from major_capsid_protein__Norovirus__AGO64038
augaagauggccagcaacgacgcuacccccuccaaugauggcgccgcggggcuggugccugagaucaacaaugaagcuauggcccucgacccggucgccggagcugccauugcugcgccccugacaggccagcaaaacaucauugauccuuggaucaugaauaacuucguucaggcccccgggggagaguuuacggugucuccuagaaauagccccggcgaagugcuucugaaccucgagcuggggccugaaauuaauccguaccuugcccaccuggcucggauguauaacggauacgccggcggcuucgagguccaggugguucucgcugggaaugccuuuaccgcgggaaaaaucaucuucgccgcuauucccccuaacuuucccaucgacaaucuguccgccgcucagauuacaaugugcccucaugugaucgucgaugugcgccaacuggagcccguuaaccucccgaugccugacgugagaaauaacuucuuucacuauaaccagggcucugaucccaagcugcggcuuauugccaugcuguacaccccucuccgcgccaauaacagcggggacgaugucuucacaguguccuguagagugcugacccggcccucucccgacuuuagcuucaauuuucuugucccuccgacaguugaauccaaaaccaagcccuucacgcugccuauccucaccauuagcgagaugucuaacucccgcuuucccgugccuaucgauagccugcauacaucucccaccgaaaauaucgugguccagugccagaacggaagagugacacuggacggcgagcucauggggaccacgcaacugcuuccgucccagauuugugcuuuccggggaguucugacacgcagcaccucuagaacauccgaucaggcggacaccgccaccccucggcuuuucaauuauuacuggcacauccagcuggacaaccuuaauggcacacccuaugauccugcugaggacauucccggcccucuggggacgcccgauuuucgcggaaaaguguucggcgucgccagccaaagaaacccggacuccaccacacgggcccaugaagcuaagguggauaccacagccgggcgcuuuaccccuaagcucggaucucuggagaucagcacggaauccgacgauuucgaccagaaucagcccacaagauuuacccccguuggcauugggguggauaacgaggcggacuuccaacaguggagccugccugauuacucuggacaguuuacccacaauaugaaccucgcuccggccgucgcccccaauuucccuggcgaacagcugcucuuuuuccggucccaacugcccagcucuggcgggagaagcaacggaauccucgacugccuggugccucaggaguggguccagcacuuuuaccaggaguccgcucccgcccaaacacagguggcucuuguucgcuaugugaacccugacaccggccggguccuguucgaagccaaacuccauaagcugggguuuaugacaaucgcgaaaaauggagauucucccauuacggugccgccuaacggcuacuucagauucgagagcuggguuaaucccuuuuauacccuggccccuauggggacaggcaacggacgccggagaauccaguga

SEQ ID NO: 28631 - RNA, 1623 nt, Artificial Sequence
  derived and/or modified sequence opt5 from major_capsid_protein__Norovirus__AGO64040
augaagauggccagcaacgacgcugcccccuccaaugauggcgcggcugggcuggugccugagaucaacaaugaagucaugccgcucgagcccguugccggagccucuccugcuacccccguggugggccagcaaaacauuaucgacccuuggauuagaaauaacuucguccaggcccccgcuggggaauuuacagugagcccucgcaauuccccgggagagauccugcuugaucuggaacucggccccgagcugaacccuuaccuugcccaccuggcgcggauguauaaugggcaugccggaggcauggagguucagauugugcucgcuggcaacgccuucacggcugggaaaaucaucuuugccgcgauucccccuggauucccccacgaaaaucugucuccgagccagaucaccaugugcccucaugucauuaucgacgugagacaacuggagcccguucuccugccuaugcccgauauucggaacaacuuuuuccacuacaaucagggcaaugaccccaaacuucgccugaucgccaugcucuauacaccucugagagcuaacaacuccggggaugacguguuuaccgucucuugucgggugcuuacaaagccgagccccgauuucgaauuuaccuuccuggugccucccacagucgaguccaagaccaaacaguuuacgcucccuauucugaagaucagcgagaugaccaauucucgcuuccccguuccgguggaaaugauguacacagccagaaacgagaaucaggugguccaaccucagaacggacgggugacccuggacggcgaacuccuggggacaacgccccuucugggaaucgauauuugcaaguuuaaaggcgagguuaucgcuaagaaucgcgacgauagauccuaucggauggacauggaaauuaccaacacagacggcaccccuaucgaucccacagaggacaccccugggcccauuggaagcccggauuuccgcggcauccucuucgggguggccucucagagaaauaaaaacgagcagaauccugccacccggggacaugaagcuaacaucaauacaggcgggaaccaauacgcgcccaagcuggcccaggucaaauuuuucuccgagagcgacgauuuugacgaacaccagcccacgguguucaccccuguuggaguggcuggcgaugacucucacccguuucgccaauggguccuucccagauauggcgggcaucugacaaauaacacccaccucgccccugccguggcuccccuguucccuggagagcagauucuguuuuuccggucccagauccccagcuccggcggguuugaacucggauacauggauugucuggucccucaggagugggugcaacauuucuaccaggaggccgcgacagcucagucugacguugcccuuauuagauuuaucaaucccgauaccggccgcgugcuguucgaagccaagcuccacaagcagggguuuauuacggucgcucacacaggcgacaacccgaucgugaugccucccaacggauauuuccgguucgaggccuggguuaaucaauuuuacagccuggcuccugugggcaccgggaacggaagacgccggguccaguga

SEQ ID NO: 28632 - RNA, 1608 nt, Artificial Sequence
  derived and/or modified sequence opt5 from major_capsid_protein__Norovirus__AGO64042
augaagauggccagcaacgacgcugcccccuccaaugauggcgcggcugggcuggugccugaggccaacaaugaaaccauggcccucgagccggucgcuggagccucuaucgcugcgccccugacaggccagaacaauguuauugacccuuggaucagacuuaacuucgugcaagcccccaauggggaauuuacggugagcccucggaacucccccggagagauucugcucaaucuggaacuuggcccugagcugaacccguaccucgcccaccugucucgcauguauaauggguacgcuggaggcgucgaggugcagguucugcucgccggcaacgcuuucaccgccgggaaacugguguuugcggccgugcccccucauuucccccuugaaaauaucagcccuggacagauuacaauguuuccccacgucaucaucgauguuagaacccuggagccggugcuccugccucuucccgacguccggaacuccuucuuucauuauaaucagcaaaacgaaccucgcaugagacugguggcuaugcucuacacaccccugcggucuaacggcagcggggaugacguguucaccgucuccugccgcguucugacaagacccagcccugauuuugacuucaauuaucucgugccgcccaccguggagucuaagacgaaaccuuuuacccugcccauucuuacaaugggagagcugaccaacucccgguucccuguccccaucgaugaacucuacacaagcccgaaugagaaccuggugguucagccucagaauggccgcugugcccuugacggggaacugcagggaaccacgcaacuccugcccacagcuauuugcucuuuuagaggccgggugaaccagaaggucuccggcgagaaucacguguggaacaugcagguuaccaauaucaacgggacaccuuucgaucccaccgaagacgugccugcuccccugggaaccccggauuucagcggccgccucuuugggguccugucucagagagaccaugacaaugccugucggucccacgaugccgugauugcgacaaacagcacgaaauucaccccuaagcugggagccauccaaauuggcacaugggaggaggacgauguccacaucaaucagcccaccaaguuuacacccguggggcuuuucgacaccgaugacuuuaaccagugggcucucccuaauuauuccggagcccugacgcuuaacaugggccuggccccgcccguugcuccuacauuccccggcgaacaaauccucuuuuuccgcucucauauuccucugaaagggggaguggccgaucccgucaucgacugccugcucccucaggaguggauucagcaccuguaccaggaaagcgcgcccucccaaagcgauguggcucuuaucagauuuaccaacccggacaccggccggguucuguucgaggccaagcuccauagaucuggguacauuacaguggccaauaccggaaaccgcccuaucgucgugcccgcuaauggcuauuuucgguucgauuccugggugaaccaguuuuacagccuggccccuauggggacaggcaauggaagacgccggguucaguga

SEQ ID NO: 28633 - RNA, 1623 nt, Artificial Sequence
  derived and/or modified sequence opt5 from major_capsid_protein__Norovirus__AGS41450
augaagauggccagcaacgacgcuaaucccuccgauggcucugccgcgaaccuggugccugaggucaauaacgaaguuauggcucucgagccgguggugggggccgccaucgcugcccccgucgcuggacagcaaaaugugaucgacccuuggaucagaaacaauuucguucaggcccccggcggggaauuuaccgugagcccucggaacgcgcccggagagauucugugguccgccccucuuggcccggaucugaaucccuaccucucucaccuggcucgcauguauaacggguacgccggaggcuucgaaguccaggugauccuugcuggcaaugccuuuacagcggggaaaauuaucuucgccgcuguuccucccaacuuuccuacggagggacugagccccucccaggugaccauguucccgcauaucauugucgacgugagacaacucgagccugugcugaucccccugccugauguccggaauaacuuuuaucacuacaaucagucuaacgacagcacaauuaagcucaucgccaugcuguauacaccccuucgcgcuaacaaugccggcgaugacguuuucaccguguccugcagagugcugacccggcccagcccugauuuugacuucauuuuucucgucccgcccacaguggaaucucgcaccaaaccuuucacgguucccauccugaccguggaggaaaugacaaacuccagauuuccuauuccccuugagaagcuguucaccgggccgagcucugccuucgucgugcagccucagaauggacgguguacaaccgauggcguucuccuggggacgacacaacugucccccgugaacaucugcaccuuucgcggagacgucacacauaucgcuggcagcagaaauuacaccaugaaccucgcgucucugaauuggaacaauuaugauccuaccgaggaaauucccgccccucuuggcacacccgacuucguggggaaaauccagggaguccugacgcagaccacaaagggcgacggguccacccggggacacaaggcuacaguguacaccggcagcgccgauuuuacgccgaaacucggguccguucaguucgccacagacaccgagaacgauuuugaaacccaucaaaauacaaaguucaccccugugggagucauucaggacggcucuacaacgcaccgcaacgagccccagcaaugggugcugcccagcuacuccggcagaaauguucacaacgugcaucuugcuccugccgucgcgccgaauuuucccggggaacagcuccuguucuuucggagcaccaugccuggauguucuggcuaucccaacacagaucuggacugccugcucccucaggagugggugcagcacuucuaccaagaggcugcccccgcccaguccgauguggcucugcuucgcuuuguuaacccugacaccgggagaguccuguucgaauguaaacuccauaagagcggauaugugacaguggcccacaccggccagcacgaucuggucauucccccgaauggguacuuucgguucgacucuugggugaaccaguucuauacgcuugcuccuaugggcaauggaaccggcagacgccgggcccuguga

SEQ ID NO: 28634 - RNA, 1623 nt, Artificial Sequence
  derived and/or modified sequence opt5 from major_capsid_protein__Norovirus__AGT62521
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccguucagggcauguuuaugucuccugacgugaaccaguccguccaauuccagaauggccggugucagaucgaugggcaacugcagggaacgacacccgugagccuuucucagcugugcaagauucgcggcaaaaccuccagcaacgcuagaguucucaaccuguccgagguggacgggacaccguucaucccucuugaaucucccgcgccugucggauuucccgaccugggcgggugugauuggcacgugaauuucaccuuucaggcccaagaccaggauccuagccaguccgucaccuucgcuacaaacgacgccagcuuugugcccuaucucggaucuaucuccccgcauaauggcggcgauuuccacgccggggacauuaucggaagccugggcuggauuucugcuccuagcgggaacucccagcugaauguuugggccauccccaaguacggaucuagccuccccgaugugacgcaccuggcgccugcugucuuuccgcccggcuucggggaggugauucuuuauuuuuacuccaccuucccuggcagcggacaacccucucagcugcagguuccuugccuccugccccaggaauuuaucacacauuucuguaacgagcaagccccuaucgccggcgaggcugcccuucugcacuauguggaccccgauaccgggcggaaucucggagaauuuaagcuguacccggacggcuucaugacaugcgucccuaacuccgugagcucugggccccagacccugccuauuaauggaguguucguuuuugucuccugggugagccgcuucuaccagcucaaacccgugggcacggcuuccgccgcgagacggcuggggcuucgcagaaucuga

SEQ ID NO: 28635 - RNA, 1629 nt, Artificial Sequence
  derived and/or modified sequence opt5 from major_capsid_protein__Norovirus__AGT62523
augaagauggccagcaacgacgcugcccccuccaccgauggcgcggcugggcuggugccugagucuaauaacgaagucauggcccucgagccgguugccggagcugcccuggcugcccccgugacaggccagacgaauaucauugacccuuggaucagaaccaacuucgugcaagcgcccaauggggaauuuacagucagcccuagaaacgcccccggagaggugcuucugaaucucgaacugggcccugagcuuaacccguaccuggcucaccucgcccgcauguauaauggguacgcuggaggcauggagguucaggugaugcuggccggcaacgcguucaccgccgggaaacuggucuuugcugccgugcccccucauuuccccguugaaaaucucuccccucagcagauuacaauguuuccccacgugaucauugaugucagaacccuggagccggugcuucugccucuccccgacgugcggaacaauuucuuucauuauaaccaaaaggaugacccuaaaaugcgcaucgucgcuaugcuguacacaccccuuagaucuaauggaagcggcgaugacguuuucaccguguccugccgggugcugacgcgccccucuccugauuuugacuucaccuaucucgucccgcccacaguggaaagcaagaccaaaccuuuuacacugcccauccugacccucggggagauguccaacagcagauucccuguucccauugaucagauguacacgucuccgaacgaggugaucuccguccagugucagaauggacggugcacacuggacggcgaacuucaagggaccacacagcugcaagugagcggaauuugugccuuuaagggccagguuaccgcccaccuccaggauaacgagcaucuguauaaugugaccaucacaaaccuuaauggcucuccuuucgaccccuccgaagacauuccugcuccccugggggucccugauuucgagggacgcguguuuggcgucaucagccagagagacaacuacaauucugggggacagaaccaacccgcgaaucggucccacgaugccgugguuccgacguacaccgcucaguauacaccuaagcucggccagauucagaucgggaccuggcaaacagacgauaucaccguggaccagcccgccaaauucacgcccgucggacugagcgauacagaccacuuuaaccagugggugguuccucgcuacgccggcgcucugaaucucaacaccaaucuggccccguccguggcgcccgucuucccuggcgaaagacuucuguuuuuccggucuuauauuccccucaaagggggauuuggcaacccugcuaucgauugccuggugccccaggaguggauucaacauuucuaccaggaggccgccccuagccuuuccgaaguggcucugguucgcuauaucaaucccgacaccgggagagcccucuuugaggcuaagcugcaccgggccggauucaugacagucagcucuaacaccuccgcgccggugguggucccugccaacggcuacuuuagauucgauagcugggugaaucaguuuuauucucuggcucccauggggacaggcaacggacgccggcggauucaguga

SEQ ID NO: 28636 - RNA, 1623 nt, Artificial Sequence; identical to SEQ ID NO: 27840
  derived and/or modified sequence opt5 from major_capsid_protein__Norovirus__AGV40221

SEQ ID NO: 28637 - RNA, 1623 nt, Artificial Sequence
  derived and/or modified sequence opt5 from major_capsid_protein__Norovirus__AGV76553
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgccgaaugugcaccuggcucccgccguggcgccuaccuuucccggggaacagcuucuguucuuuagauccacaaugccuggauguagcggcuaucccaacauggaccucgauugccugcugccucaggaguggguucaauacuucuaucaggaggcugcccccgcccagucugacgucgcucuccugcgguuugugaauccggauaccgggagagugcuuuucgaauguaagcugcauaaauccggauacgucacaguggcccacagcggccagcaugaccucguuauuccucccaacggguauuuucgcuucgauucuugggugaaccaauucuacacccuggcuccuaugggcaauggaacgggccggagacgcgcccuuuga

SEQ ID NO: 28638 - RNA, 1623 nt, Artificial Sequence; identical to SEQ ID NO: 27141
  derived and/or modified sequence opt5 from major_capsid_protein__Norovirus__AGV76554

SEQ ID NO: 28639 - RNA, 1623 nt, Artificial Sequence; identical to SEQ ID NO: 27141
  derived and/or modified sequence opt5 from major_capsid_protein__Norovirus__AGV76555

SEQ ID NO: 28640 - RNA, 1623 nt, Artificial Sequence; identical to SEQ ID NO: 27141
  derived and/or modified sequence opt5 from major_capsid_protein__Norovirus__AGV76556

SEQ ID NO: 28641 - RNA, 1623 nt, Artificial Sequence; identical to SEQ ID NO: 27141
  derived and/or modified sequence opt5 from major_capsid_protein__Norovirus__AGV76557

SEQ ID NO: 28642 - RNA, 1623 nt, Artificial Sequence; identical to SEQ ID NO: 27141
  derived and/or modified sequence opt5 from major_capsid_protein__Norovirus__AGV76558

SEQ ID NO: 28643 - RNA, 1623 nt, Artificial Sequence; identical to SEQ ID NO: 27141
  derived and/or modified sequence opt5 from major_capsid_protein__Norovirus__AGV76559

SEQ ID NO: 28644 - RNA, 1623 nt, Artificial Sequence; identical to SEQ ID NO: 27141
  derived and/or modified sequence opt5 from major_capsid_protein__Norovirus__AGV76560

SEQ ID NO: 28645 - RNA, 1623 nt, Artificial Sequence; identical to SEQ ID NO: 27141
  derived and/or modified sequence opt5 from major_capsid_protein__Norovirus__AGV76561

SEQ ID NO: 28646 - RNA, 1623 nt, Artificial Sequence; identical to SEQ ID NO: 27141
  derived and/or modified sequence opt5 from major_capsid_protein__Norovirus__AGV76562

SEQ ID NO: 28647 - RNA, 1623 nt, Artificial Sequence; identical to SEQ ID NO: 27141
  derived and/or modified sequence opt5 from major_capsid_protein__Norovirus__AGV76563

SEQ ID NO: 28648 - RNA, 1623 nt, Artificial Sequence
  derived and/or modified sequence opt5 from major_capsid_protein__Norovirus__AGV76564
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgccgaaugugcaccuggcucccgccguggcgccuaccuuucccggggaacagcuucuguucuuuagauccacaaugccuggauguagcggcuaucccucuauggaccucgauugccugcugccucaggaguggguucaauacuucuaucaggaggcugcccccgcccaguccgacgucgcucuccugcgguuugugaacccggauaccgggagagugcuuuucgaauguaagcugcauaaaagcggauacgucacaguggcccacaccggccagcaugaccucguuauuccucccaauggguauuuucgcuucgauucuugggugaaccaauucuacacgcuggcuccuaugggcaacggaaccggccggagacgcgcccuuuga

SEQ ID NO: 28649 - RNA, 1623 nt, Artificial Sequence; identical to SEQ ID NO: 27141
  derived and/or modified sequence opt5 from major_capsid_protein__Norovirus__AGV76565

SEQ ID NO: 28650 - RNA, 1623 nt, Artificial Sequence; identical to SEQ ID NO: 27141
  derived and/or modified sequence opt5 from major_capsid_protein__Norovirus__AGV76566

SEQ ID NO: 28651 - RNA, 1623 nt, Artificial Sequence
  derived and/or modified sequence opt5 from major_capsid_protein__Norovirus__AGV76567
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgggacagacaccgaucaugacuuugaggccaaucagaacaccaaauucacacccguuggagugauccaggauggcucuaccacacaccggaaugaaccccaacaguggguccucccuagcuacuccggccgcaacacgccgaaugugcaccuggcucccgccguggcgccuaccuuucccggggagcagcuucuguucuuuagaagcacaaugccuggauguucuggcuaucccaacauggaccucgauugccugcugccucaggaauggguucaauacuucuaucaggaggcugcccccgcccaguccgacgucgcucuccugcgguuugugaauccggauaccgggagagugcuuuucgaguguaagcugcauaaaagcggauacgucacaguggcccacaccggccagcaugaccucguuauuccucccaacggguauuuucgcuucgauucuugggugaaccaauucuacacgcuggcuccuaugggcaauggaaccggccggagacgcgcccuuuga

SEQ ID NO: 28652 - RNA, 1623 nt, Artificial Sequence
  derived and/or modified sequence opt5 from major_capsid_protein__Norovirus__AGV76568
augaagauggccagcuccgacgcuaaccccucugauggcagcgccgcgucccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugaucgacgugagacaacucgagccuguccugauuccccugccugauguucggaauaacuuuuaucacuacaaucaguccaacgaccccacaaucaagcucauugccaugcuguauacaccccuucgcgcuaauaacgccggcgaugacguguucaccgugagcugcagaguccugacccggccuucuccggauuuugacuucaucuuucucgugcccccuacaguugaaucccgcaccaaacccuucagcgugccuguccugacgguggaggaaaugaccaacucuagauuucccauuccgcuugagaagcuguucacagggccuuccagcgccuucguugugcagccccagaauggacgguguaccacagauggcguccuccuggggaccacgcaacugucuccugugaacaucugcacauuucgcggagacgucacccauauuacaggcuccagaaauuacaccaugaaccucgcuagccagaauuggaacaauuaugaucccaccgaggaaaucccugcgccccugggcacaccggacuucguggggaaaauccagggaguucuuacgcagaccacacggaccgacggcuccacacgcgggcacaaggccaccguguacacgggaucugcugauuuugccccuaagcugggcagaguccaauucgagacagacaccgaucaugacuuugaagccaaccagaauaccaaauucacacccguggggguuauucaggauggaagcaccacacaccggaacgagccccaacagugggugcucccuuccuacagcggccgcaauacgccgaacguccaccuggcucccgccguggcgccuaccuuucccggcgaacagcuucuguucuuuagaucuacaaugccuggguguuccggauaucccaauauggaccucgauugccugcugccucaggagugggugcaauacuucuaucaggaggcugcccccgcccagagcgacguugcucuccugcgguuugucaacccggauaccggcagagugcuuuucgaauguaagcugcauaaaucuggguacgugacagucgcccacaccggacagcaugaccucgugaucccucccaauggcuauuuucgcuucgauagcuggguuaaccaauucuacacgcuggcuccuauggggaacggcaccggacggagacgcgcccuuuga

SEQ ID NO: 28653 - RNA, 1623 nt, Artificial Sequence; identical to SEQ ID NO: 27141
  derived and/or modified sequence opt5 from major_capsid_protein__Norovirus__AGV76569

SEQ ID NO: 28654 - RNA, 1623 nt, Artificial Sequence; identical to SEQ ID NO: 27141
  derived and/or modified sequence opt5 from major_capsid_protein__Norovirus__AGV76570

SEQ ID NO: 28655 - RNA, 1623 nt, Artificial Sequence
  derived and/or modified sequence opt5 from major_capsid_protein__Norovirus__AGV76571
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacauuaugaaucucgcuucccagaacuggagcaauuaugaucccaccgaggaaaucccugcgccccugggcaccccggacuucguugggaaaauccagggagugcuuacacagacgacccggacagacggcuccacccgcgggcacaaggccacagucuacaccggaucugcugauuuugccccuaagcugggcagagugcaauucgagacggacacagaucaugacuuugaagccaaccagaauaccaaauucacccccguuggggugauucaggauggaagcacaacccaccggaacgagccccaacaguggguccucccuuccuacagcggccgcaauacaccgaacgugcaccuggcucccgccguggcgccuacguuucccggcgaacagcuucuguucuuuagaucuaccaugccuggguguuccggauaucccaauauggaccucgauugccugcugccucaggaguggguucaauacuucuaucaggaggcugcccccgcccagagcgacgucgcucuccugcgguuugugaacccggauacaggcagagugcuuuucgaauguaagcugcauaaaucuggguacgucaccguggcccacacaggacagcaugaccucguuaucccucccaauggcuauuuucgcuucgauagcugggugaaccaauucuacacccuggcuccuauggggaacggcacgggacggagacgcgcccuuuga

SEQ ID NO: 28656 - RNA, 1623 nt, Artificial Sequence
  derived and/or modified sequence opt5 from major_capsid_protein__Norovirus__AGV76572
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcuccgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauuggaacaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgcacaacgugcaucuggcuccggccguggcgcccaccuuuccuggcgaacagcuucuguucuuuagaucuacaaugcccggguguuccggauauccuaauauggaccucgauugccugcugccccaggaguggguucaauacuucuaucaggaggcugccccugcccagagcgacgucgcucuccugcgguuugugaaccccgauaccggcagagugcuuuucgaauguaagcugcacaaaucuggguacgucacaguggcccauaccggacagcacgaccucguuauuccgccuaauggcuauuuucgcuucgauagcugggugaaccaauucuacacgcuggcucccauggggaacggcaccggacggagacgcgccgucuga

SEQ ID NO: 28657 - RNA, 1623 nt, Artificial Sequence; identical to SEQ ID NO: 27139
  derived and/or modified sequence opt5 from major_capsid_protein__Norovirus__AGV76573

SEQ ID NO: 28658 - RNA, 1623 nt, Artificial Sequence
  derived and/or modified sequence opt5 from major_capsid_protein__Norovirus__AGV76574
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgaucaugacuuugaagccaaucagaacaccaaauucacacccguuggggugauccaggauggaggcaccacacaccggaaugagccccaacaguggguccucccuucuuacagcggccgcaacacgcacaaugugcaucuggcuccggccguggcgcccaccuuuccuggggaacagcuucuguucuuuagauccacaaugcccggauguagcggcuauccuaacauggaccucgauugccugauuccccaggaguggguucaauacuucuaucaggaggcugccccugcccagucugacgucgcucugcuccgguuugugaaucccgauaccgggagagugcuguucgaauguaaacuucacaaguccggauacgucacaguggcccauaccggccagcacgaccugguuaucccgccuaacggguauuuucgcuucgauagcugggugaaccaauucuacacgcucgcucccaugggcaauggaaccggccggagacgcgccgucuga

SEQ ID NO: 28659 - RNA, 1623 nt, Artificial Sequence
  derived and/or modified sequence opt5 from major_capsid_protein__Norovirus__AGV76575
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggaauaacuaugaucccaccgaggaaauuccugcgccccugggcacaccggacuucguugggaaaauccagggagugcuuacgcagaccacacggaccgacggcagcacacgcgggcacaaggccaccgucuacacgggauccgcugauuuugccccuaagcugggcagagugcaauucgagacagacaccgauaaugacuuugaagccaaccagaauaccaaauucacacccguuggggugauccaggauggaggcaccacacaucggaacgagccccaacaguggguccucccuucuuacagcggccgcaauacgcacaacgugcaccuggcuccggccguggcgcccaccuuuccuggggaacagcuucuguucuuuagauccacaaugcccggauguagcggcuauccuaauauggaccucgauugccugauuccccaggaguggguucaauacuucuaucaggaggcugccccugcccagucugacgucgcucugcuccgguuugugaaccccgauaccgggagagugcuguucgaauguaaacuucauaaguccggauacgucacaguggcccacaccggccagcaugaccugguuaucccgccuaacggguauuuucgcuucgauagcugggugaaucaauucuacacgcucgcucccaugggcaacggaaccggccggagacgcgccgucuga

SEQ ID NO: 28660 - RNA, 1623 nt, Artificial Sequence; identical to SEQ ID NO: 27139
  derived and/or modified sequence opt5 from major_capsid_protein__Norovirus__AHA44844

SEQ ID NO: 28661 - RNA, 1623 nt, Artificial Sequence
  derived and/or modified sequence opt5 from major_capsid_protein__Norovirus__AHA44847
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaauuaucuucgccgcuguuccucccaauuuuccuacggagggacugucccccucucaggugaccauguucccgcauaucauugucgacgugagacaacucgagccugugcugaucccccugccugauguccggaacaauuuuuaucacuacaaccagagcaaugaccccacaauuaagcucaucgccaugcuguauacaccccuucgcgcuaacaacgccggcgaugacguuuucaccguguccugcagagugcugacccggccuagcccggauuuugacuucauuuuucucgugcccccuacagucgaaucucgcaccaaacccuucuccguuccuauccugacgguggaggaaaugaccaauagcagauuucccauuccgcuugagaagcuguucacagggccuucuuccgccuucgucgugcagccccagaacggacgguguaccacagauggcguucuccuggggaccacgcaacugagcccugugaauaucugcacauuucgcggagacaucacccauauuacaggcucuagaaacuacaccaugaaucucgcuucccagaacuggaauaacuaugaucccaccgaggaaaucccugcgccccugggcacaccggacuucgucgggaaaauucagggagugcuuacgcagaccacacgggccgacggcagcacccgcgggcacaaggcuaucgucuacacaggauccgccgauuuugccccuaagcugggcagagugcaauucgagaccgacacggaucaugacuuugaagcuaaucagaacacaaaauucacccccguuggggugacccaggauggaucuacaacccaccggaaugagccccaacaguggguccucccuagcuacuccggccgcaacacacacaaugugcaucuggccccggcgguugcucccacguuuccuggcgaacagcuucuguucuuuagaagcaccaugcccggguguucuggauauccuaacauggaccucgauugccugcugccccaggagugggugcaauacuucuaucaggaggccgccccugcucaguccgacgucgcccuccugcgguuugugaaucccgauacaggcagagugcuuuucgaauguaagcugcacaaaagcggguacguuaccgucgcucauacaggacagcacgaccucgugauuccgccuaacggcuauuuucgcuucgauucuugggugaaccaauucuacacccuggcccccauggggaauggcacgggacggagacgcgucguguga

SEQ ID NO: 28662 - RNA, 1623 nt, Artificial Sequence
  derived and/or modified sequence opt5 from major_capsid_protein__Norovirus__AHB62404
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcuccaacuacaccaugaaucucgccucucagaacuggaauagcuaugauccuaccgaggaaauccccgcuccucugggcacacccgacuucgucgggaaaauucagggagugcuuacgcagaccacaagaaccgacggcuccacacgggggcacaaggcgaccguuuacacgggaagcgccgauuuuucuccgaagcugggccgcgugcaauucgcuacagacaccgauaacgacuuugagaccaaucagaacacaaaauucaccccugucggggugauccaggauggagccacaacgcauagaaaugaaccccaacaguggguucuccccuccuacagcggccggaacacccacaaugugcaccuggccccugcugucgccccgacauuucccggcgagcagcuucuguucuuucgcucuaccaugccuggguguagcggauaucccaacauggaccucgauugccugcugccucaggaaugggugcaauacuucuaucaggaggcggcucccgcccaguccgacguggcccuccugagauuuguuaauccugauacaggccggguccuuuucgaguguaagcugcauaaaucuggguacgugaccguggcucacacgggacagcaugaccucgucauucccccgaacggcuauuuuagauucgauagcugggugaaccaauucuacacccuggccccuauggggaauggcacaggacgccggagagcucuuuga

SEQ ID NO: 28663 - RNA, 1623 nt, Artificial Sequence; identical to SEQ ID NO: 27141
  derived and/or modified sequence opt5 from major_capsid_protein__Norovirus__AHB62406

SEQ ID NO: 28664 - RNA, 1623 nt, Artificial Sequence
  derived and/or modified sequence opt5 from major_capsid_protein__Norovirus__AID51515
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcucccugggaccacgcaacugagccccgucaauauuugcacauuucgcggagacgugacccauaucacaggcucuagaaacuacaccaugaaucuggcuucccagaacuggaauaacuaugauccuaccgaggaaauucccgcgccgcucggcacaccugacuucguugggaaaauccagggagugcugacgcagaccacacggagcgacggcuccacccgcgggcacaaggccacagucuacaccggaucugcugauuuugcccccaaacuuggcagagugcaauucgagacggacacagaucgggacuuugaagccaaucagaacaccaaguucacccccguuggggugauccaggauggaggcacaacccaucgcaaugagccucaacaguggguccugccgagcuacuccggcagaaacacacccaaugugcaccucgcuccugccguggcgcccacguuuccuggggaacagcugcuuuucuuucggagcaccaugcccggauguucuggcuauccuaacauggaccuggauugccuccugccccaggaguggguucaauacuucuaucaggaggcugccccggcccaguccgacgucgcucugcucagauuugugaauccugauacagggcgcgugcuguucgaauguaaacuucacaagagcggauacgucaccguggcccauacaggccagcacgaccugguuauucccccuaacggguauuuucgguucgauucuugggugaaccaauucuacacccucgcucccaugggcaauggaacgggcagacgccgggcccuguga

SEQ ID NO: 28665 - RNA, 1623 nt, Artificial Sequence; identical to SEQ ID NO: 27133
  derived and/or modified sequence opt5 from major_capsid_protein__Norovirus__AID51517

SEQ ID NO: 28666 - RNA, 1623 nt, Artificial Sequence
  derived and/or modified sequence opt5 from major_capsid_protein__Norovirus__AID51519
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcauguauaauggguacgccggaggcuucgaaguccaggugauccuugcuggcaacgccuuuacagcggggaaaguuauuuucgccgcugugccucccaauuuuccuacggagggacugucccccucucaggucaccauguucccgcauaucgugguggacgucagacaacucgagccuguucugaucccccugccugaugugcggaacaauuuuuaucacuacaaccagagcaaugaccccacaauuaagcucaucgccaugcuguauacaccccuucgcgcuaacaacgccggcgaugacguguucaccgucuccugcagagugcugacccggccuagcccggauuuugacuucauuuuucucguucccccuacaguggaaucucgcaccaaacccuucuccgucccugugcugacgguugaggaaaugaccaauagcagauuucccaucccgcuugagaagcuguucacagggccuucuuccgccuucgugguccagccccagaacggacgguguaccacagauggcgugcuccuggggaccacgcaacugagcccugucaauauuugcacauuucgcggagacgugacccauaucacaggcucuagaaacuacaccaugaaucucgcuucccagaacuggagcaauuaugaucccaccgaggaaauuccugcgccccugggcacaccggacuucguugggaaaauccagggagugcuuacgcagaccacacggaccgacggcuccacacgcgggcacaaggccaccgucuacacgggaucugcugauuuugccccuaagcugggcagagugcaauucgagacagacaccgaucaugacuuugaagccaaccagaauaccaaauucacacccguuggggugauccaggauggaagcaccacacaccggaacgagccccaacaguggguccucccuuccuacagcggccgcaauacgccgaacgugcaccuggcucccgccguggcgccuaccuuucccggcgaacagcuucuguucuuuagaucuacaaugccuggguguuccggauaucccaauauggaccucgauugccugcugccucaggaguggguucaauacuucuaucaggaggcugcccccgcccagagcgacgucgcucuccugcgguuugugaacccggauaccggcagagugcuuuucgaauguaagcugcauaaaucucgcuacgucacaguggcccacaccgggcagcaugaccucguuauuccucccaauggauauuuucgguucgauagcugggugaaccaauucuacacgcuggcuccuaugggcaacgggaccggcagacgccgggcccuuuga

SEQ ID NO: 28667 - RNA, 1623 nt, Artificial Sequence
  derived and/or modified sequence opt5 from major_capsid_protein__Norovirus__AID51522
augaagauggccagcuccgacgcuucucccagcgauggcuccgccgcgaaccuggugccugaggucaauaacgaaguuauggcucucgagccgguggugggggccgccaucgcugcccccgucgcuggacagcaaaaugugauugacccuuggaucagaaacaauuucguucaggcccccggcggggaauuuaccgugucuccucggaacgcgcccggagagauucuguggagcgccccucuuggcccggaucugaaucccuaccucucccaccuggcucgcauguauaacggguacgccggaggcuucgaaguccaggugauccuugcuggcaaugccuuuacagcggggaaaguuauuuucgccgcugugccucccaacuuuccuacggagggacugucucccagccaggucaccauguucccgcauaucgugguggacgucagacaacucgagccuguucugaucccccugccugaugugcggaauaacuuuuaucacuacaaucaguccaacgaccccacaauuaagcucaucgccaugcuguauacaccccuucgcgcuaauaacgccggcgaugacguguucaccgucagcugcagagugcugacccggccuucuccggauuuugacuucauuuuucucguucccccuacaguggaaucccgcaccaaacccuucagcgucccugugcugacgguugaggaaaugaccaacucuagauuucccaucccgcuugagaagcuguucacagggccuuccagcgccuucgugguccagccccagaauggacgguguaccacagauggcgugcuccuggggaccacgcaacugucuccugucaacauuugcacauuucgcggagacgugacccauaucacaggcuccagaaauuacaccaugaaccucgcuagccagaauugguccaacuaugaucccaccgaggaaauuccugcgccccugggcacaccggacuucguugggaaaauccagggagugcuuacgcagaccacacggaccgacggcucuacacgcgggcacaaggccaccgucuacacgggaagcgcugauuuugccccuaagcugggcagagugcaauucgagacagacaccgaucgggacuuugaagccaaucagaacaccaaauucacacccguuggggugauccaggauggauccaccacacaucgcaaugagccccaacaguggguccucccuagcuacucuggcagaaacacgccgaaugugcaccuggcucccgccguggcgccuaccuuucccggcgaacagcuucuguucuuucgguccacaaugccuggguguagcggauaucccaacauggaccucgauugccugcugccucaggaguggguucaauacuucuaucaggaggcugcccccgcccagucugacgucgcucuccugagauuugugaauccggauaccggccgcgugcuuuucgaauguaagcugcacaaaagcggguacgucacaguggcccauaccggacagcacgaccucguuauuccucccaacggcuauuuucgguucgauuccugggugaaucaauucuacacgcuggcuccuauggggaacggcaccggaagacgccgggcccuuuga

SEQ ID NO: 28668 - RNA, 1623 nt, Artificial Sequence; identical to SEQ ID NO: 27139
  derived and/or modified sequence opt5 from major_capsid_protein__Norovirus__AID51531

SEQ ID NO: 28669 - RNA, 1623 nt, Artificial Sequence; identical to SEQ ID NO: 27085
  derived and/or modified sequence opt5 from major_capsid_protein__Norovirus__AID51534

SEQ ID NO: 28670 - RNA, 1623 nt, Artificial Sequence; identical to SEQ ID NO: 27085
  derived and/or modified sequence opt5 from major_capsid_protein__Norovirus__AIL49840

SEQ ID NO: 28671 - RNA, 1623 nt, Artificial Sequence
  derived and/or modified sequence opt5 from major_capsid_protein__Norovirus__AIL49843
augaagauggccagcuccgacgcuaaccccucugauggcagcgccgcgaaucuggugccugaggucaacaaugaaguuauggcucucgagccguucgugggggccgccaucgcugcccccguggcuggacagcaaaacgucauugacccuuggaucagaaauaacuuugugcaggcccccggcggggaguucaccguuuccccucggaaugcgcccggagaaauucuguggucugccccucuuggcccggaucugaaccccuaccucagccaccuggcucgcauguauaauggguacgccggaggcuuugaagugcaggucauccuugcuggcaacgccuucacagcggggaaagugauuuuugccgcuguuccucccaauuucccuacggagggacugucccccucucaggugaccauguuuccgcauaucgucguggacgugagacaacucgagccuguccugaucccccugccugauguucggaacaauuucuaucacuacaaccagagcaaugaccccacaauuaagcucaucgccaugcuguauacaccccuucgcgcuaacaacgccggcgaugacguguuuaccguguccugcagaguccugacccggccuagcccggauuucgacuuuauuuuccucgugcccccuacaguugaaucucgcaccaaacccuuuuccgugccuguccugacgguggaggaaaugaccaauagcagauuccccaucccgcuugagaagcuguucacagggccuucuuccgccuuuguugugcagccccagaacggacgguguaccacagauggcguccuccuggggaccacgcaacugagcccugugaauauuugcacauuccgcggagacgucacccauaucacaggcucuagaaacuacaccaugaaucucgcuucccagaacuggaauaacuaugaucugaccgaggaaauucccgcgccucuuggcacacccgacuuuguggggaaaauccagggaguucugacgcagaccacacggaccgacggcagcacacgcgggcacaaggccaccguguacacgggauccgcugauuucgccccgaagcucggcagaguccaauuugagacagacaccgaucaugacuucgaagccaaucagaacaccaaauuuacaccuguggggguuauccaggauggaggcaccacacaccggucugagccccaacagugggugcugcccagcuacuccggccgcaauacgccuaacguccaccuugcuccggccguggcgcccaccuucccuggggaacagcugcucuuuuucagaagcacaaugcccggauguucuggcuauccuaauauggaccuggauugccugcucccccaggagugggugcaauacuuuuaucaggaggcugccccugcccaguccgacguugcucugcuucgguucgucaaccccgauaccgggagagugcuguuugaauguaagcuccauaaaagcggauacgugacagucgcccacaccggccagcaugaccuggugauuccgccuaauggguauuuccgcuucgauucuuggguuaaccaauuuuacacgcuugcucccaugggcaacggaaccggccggagacgcgcccuguga

SEQ ID NO: 28672 - RNA, 1623 nt, Artificial Sequence
  derived and/or modified sequence opt5 from major_capsid_protein__Norovirus__AIV99914
augaagauggccagcuccgacgcuaaccccucugauggcagcgccgcgaaucuggugccugaggucaacaaugaaguuauggcucucgagccgguggugggggccgccaucgcugcccccgucgcuggacagcaaaacgugauugacccuuggaucagaaauaacuucguucaggcccccggcggggaauuuaccguguccccucggaaugcgcccggagagauucuguggucugccccucuuggcccggaucugaaccccuaccucagccaccuggcucgcacauauaauggguacgccggaggcuucgaaguccaggugauccuugcuggcaacgccuuuacggcggggaaaguuauuuucgccgcugugccucccaauuuuccuaccgagggacugucccccucucaggucacaauguucccgcauaucgugguggacgccagacaacucgagccuguccugaucccccugccugauguucggaacaauuuuuaucacuacaaccagagcaaugaccccaccauuaagcucaucgcuaugcuguauacaccccuucgcgccaacaacgccggcgaugacguguucaccguguccugcagaguccugacacggccuagcccggauuuugacuucauuuuucucgugcccccuaccguugaaucucgcacgaaacccuucuccgugccuguccugaccguggaggaaaugacaaauagcagauuucccaucccgcuugagaagcuguucaccgggccuucuuccgcuuucguugugcagccccagaacagccgguguacaaccgauggaguccuccugggcacgacacaacugucuccugugaauauuugcaccuuucgcggggacgucacacauaucaccggauccagaaacuacaccaugaaucucgcgagccagaacuggaauaacuaugaucccacagaggaaauuccugugccccugggcacgccggacuucguuggcaaaauccagggggugcuuacccagacaacccggacagacggauccacccgcggccacaaggccacggucuacacagggucugcugauuuugccccuaagcugggaagagugcaauucgagaccgacaccgaucaugacuuugaagccaaucagaacacaaaauucacccccguuggcgugauccaggaugggggaacaacgcaccggaaugagccccaacaguggguccucccuagcuacuccggccgcaacacccacaaugugcaucuggcuccggccguggcgcccacauuuccuggcgaacagcuucuguucuuuagaagcaccaugcccggguguucuggauauccuaacauggaccucgauugccugcugccccaggaguggguucaauacuucuaucagggcgcugccccugcccaguccgacgucgcucuccugcgguuugugaaucccgauacagggagagugcuuuucgaguguaagcugcacaaaagcggauacgucaccguggcccauacgggccagcacgaccucguuauuccgccuaacggguauuuucgcuucgauucuugggugaaccaauucuacacccuggcucccaugggcaauggaacaggccggagacgcgccgucuga

SEQ ID NO: 28673 - RNA, 1635 nt, Artificial Sequence
  derived and/or modified sequence opt5 from major_capsid_protein__Norovirus__AJP13619
auggccagcaaggacgcuccccaguccgccgauggcgcgucuggggcuggacaacuggugccugaggucaacaccgccgacccgcuccccauggaaccuguugccggccccacaacggcuguggccaccgcuggacaggugaauaugaucgauccuuggauugucaacaauuucgugcagagcccccagggggaguuuacaaucuccccuaacaauaccccgggcgacauucuguucgaucuucaacuggggccccaccucaacccuuuucugucucaucuuagccagauguacaauggauggguuggcaacaugagagugcggauccugcucgccggcaaugcguucuccgccgggaaaauuaucgucugcugugugcccccuggauuuacaucuagcucccugaccaucgcucaggccacacuguucccccacguuauugcugacgugcgcacccucgaaccgaucgagaugccucuggaagaugucagaaacgugcuuuaucauacgaaugacaaccagcccaccaugcggcuggugugcaugcucuacacaccucugcgcaccggcgggggaagcggcaauucugauuccuuugucguugccgggagagugcuuacagcgcccagcucugacuucuccuuucuguuccucgugcccccuaccauugagcaaaagacgcgggccuuuacagucccgaacaucccccugcagacccugagcaauucucgcuucccuucccucauucagggaaugauccugagccccgaugcuucccaggugguucaauuucagaacggcagaugucuuauugacggccagcugcucgggacaaccccugccaccucuggacaacuguuccgggugcgcggcaaaaucaaccagggggcuagaacacuuaaucugacggaggucgauggaaagcccuucauggccuuugacagcccggccccugugggcuuccccgacuuugggaaaugcgauuggcacaugcggaucuccaagaccccuaacaauacaagcucuggagaccccaugcgcuccguuagcgugcagaccaacguccagggcuucgugccucaucucggcucuauucaauuugaugaagucuucaaucaccccacaggggacuauaucggaaccauugaguggaucagccagccguccacgccucccggcacagauauuaaccugugggaaauccccgacuacgggucuagccugucccaggcugcgaaucucgccccuccgguguuucccccuggauucggcgaggcucugguuuauuuugugagcgccuuccccgggccuaacaauagaucugcccccaacgaugucccuugucuucugccccaggaguacaucacccacuuuguguccgaacaagcuccgaccaugggcgacgccgcgcuccugcauuauguugauccugacacaaaucggaaccuuggagaguucaagcuguaccccggcggguaccugaccugcgugccuaauggagucggcgcugggccccagcagcucccgcugaacggaguguuucucuucgugagcuggguuucucgcuucuaucagcugaaaccugucggcacagccuccacggccagagggcggcuuggcgugagacgcauuuga

SEQ ID NO: 28674 - RNA, 1632 nt, Artificial Sequence
  derived and/or modified sequence opt5 from major_capsid_protein__Norovirus__AJP13620
auggccagcaaggacgcucccaccaacauggauggaacauccggggccggacagcuggugccugaggcgaauacggcugaaccgaucucuauggagcccgucgccggcgccguuaccgcugccgcuacagccgggcaagugaacaugauugacccuuggaucaugaauaacuacgugcaggcgccccagggagaguucaccauuagcccuaauaacacacccggcgauauccucuuugaccugcagcuugggccucaccugaauccguuccucucccaucuggcccaaauguauaacggaugggucggcaauaugaaagugagaguucuucuggcuggcaacgccuuuaccgcugggaagauuaucaucucuugcauucccccuggauucguggcccagaauaucagcauugcgcaggccacaauguuuccccacgucaucgcugaugugcggguucucgaaccuauugaagugccccuggaggacguccgcaacgugcuguuccauaauaacgauaauaccccgacgaugagacucguguguauccuguacaccccucuucgggccuccggcucuagcuccgggacagaccccuuugucauugcuggacgcguucugaccugcccuagccccgauuucucuuuucucuuccuggugcccccuaacguggagcagaaaacaaagccguuuuccguccccaaccuuccucugaauacccucagcaacucuagagugcccucccugaucaaaagcaugaugguuucucgggaccacggccaaauggugcaguuccagaaugggcgcgucacgcuggauggacagcuccaaggcacaaccccuacauccgccagccagcuguguaagaucagaggcuccguguuucaugccaacgggggaaauggcuauaaccuuaccgaacuggacgggucucccuaccacgcuuucgagagcccggcgccuauuggauuccccgaucucggcgaaugcgacuggcacauggaggccuccccuaccacacaguuuaauacgggggacguuaucaagcaaauuaacgugaaacaggagagcgcuuucgcuccccaucugggaaccauccaggccgauggccuuucugacgucuccgugaauacaaacaugauugccaagcugggcugggucagcccugugucugaugggcacaaacgggacguugaucccugggugaucccgcgcuauggaagcacccucacagaagccgcgcagcuggcuccucccaucuaucccccuggcuuuggggaggccauugucuucuuuauguccgacuucccgaucgcccauggaaccaauggccugucugugcccuguacgauuccucaagaauuuguuacacacuucgugaacgagcaggcucccaccagaggggaagccgcucuccugcacuaccuugauccugacacccaucggaaucugggcgaguuuaagcucuaccccgauggauucaugacaugcgucccuaacaccagcggcacagggccccagacgcugccgaucaauggaguguuuguguucguuuccugggucagccgcuuuuaccagcuuaaaccugugggcaccgccgggcccgcgagacggcugggcauucgcagaucuuga

SEQ ID NO: 28675 - RNA, 1647 nt, Artificial Sequence
  derived and/or modified sequence opt5 from major_capsid_protein__Norovirus__AJP13621
augaagauggccagcaacgacgcugcccccuccaaugauggcgcggcugggcuggugccugagaucaacaaugaagccauggcccucgagccggucgcuggagccgcuauugccgcgccccugaccggccagcaaaacaucauugacccuuggaucaugaauaacuucguucaggcccccgggggagaauuuacagugucuccuagaaauagccccggcgaggugcuucugaaccucgaacuggggccugagauuaauccguaccuugcucaccuggcccggauguauaacggauacgcuggcggcuucgagguccaggugguucucgccgggaaugcguuuacggccggaaaaaucaucuucgcugccauucccccuaacuuucccaucgauaaucuguccgcugcccagauuaccaugugcccucaugugaucgucgacgugcgccaacuggaacccguuaaccucccgaugccugaugugagaaauaacuucuuucacuauaaccagggcucugacagccggcugcgccuuauugccaugcuguacacaccccucagagcuaauaacuccggggaugacgucuucaccgugucuugucgggugcugacacgcccuagccccgauuuuuccuucaauuuucuuguucccccuaccgucgagagcaagacaaaaccguucucucugcccauccucaccauuuccgaaaugagcaacucuagauuuccugugcccaucgacucccugcauacgagcccuaccgagaauaucgugguccagugccagaacggacgggugacacuggauggcgagcucauggggaccacacaacugcuucccucucagauuuguaccuuccgcggaguucugacgagauccacaagccgggcguccgaccaggccgauaccgcuacaccgcgccucuucaauuauuacuggcacauccagcuggacaaccuuaauggcaccccuuaugaccccgccgaagauauuccuggcccccuggggaccccugacuuuagaggaaagguguucggcgucgccucucaacggaaccccgauagcacaacgcgcgcucaugaggccaaaaucgacaccacauccgggagauuuaccccgaagcucggaagccuggaaauuucuacagaguccgaugacuucgaucagaauaagccuacccgguuuacgcccgugggcaucgggguugaccacgaagcggauuuccagcaaugggcucugcccgacuacgccggacaguuuacacacaacaugaaucucgccccugcuguggccccgaacuuccccggcgagcagcugcuguuuuucagaagccagcuuccuucuagcggcgggcgcuccaauggaauccucgauugccuggucccccaagagugggugcagcauuuuuaccaggaaucugcuccuagccagucccaagucgcccuugugcgguauauuaaccccgacaccggcagaguucuguucgaggcgaaacuccacaagcugggguuuaucaccauugccaaaaacggagacagcccuaucacagugcccccgaauggcuacuuccgcuucgaaucuugggucaacccuuuuuauacccuggcucccauggggacaggcaauggacggagacgcauucaguga

SEQ ID NO: 28676 - RNA, 1653 nt, Artificial Sequence
  derived and/or modified sequence opt5 from major_capsid_protein__Norovirus__AJP13622
augaagauggccagcaacgacgcugcccccuccaaugauggcgcggcuaaccuggugccugaggccaauaacgaagucauggcccucgagccgguugugggggcuucuaucgccgcucccguggucggacagcaaaauauuaucgacccuuggauuagagaaaacuucgugcaggcgccccagggcgaguuuaccguuagcccucgcaauucccccggggaaaugcugcuuaaccuggagcucggaccugagcugaauccguaccuuucucaccugagccggauguauaacggcuacgccgggggaaugcaagugcaggucgugcucgccggcaaugcuuucacagccggcaagaucauuuuugcugccguucccccucauuuccccguggauaacaucuccgcggcccagaucacgaugugcccucacgucauuguggacgugagacagcuggaacccguccugcucccgcugccugauauccggaaucgcuuuuuccauuauaaccaggagaauacccccagaaugcggcuuguugcuaugcuguacacaccucuccgcgccaacucuggggaagacguguuuaccgugagcuguagaguccugacacggcccgcucccgauuucgaguuuaccuuccuugugccuccgacaguugaguccaagaccaaacccuuuacgcugccuauucucacccugggagaacugagcaacucucgcuuccccgccgccaucgacaugcucuauacagauccuaaugaguccauugugguccaaccccagaacggcagaugcacccuggacgggacacuucagggaaccacgcagcuggugccgacacaaaucugugcuuuucggggcacccucauuagccagacagcgcgcgccgcugauucuaccgacuccccucagagagcccgggaucacccccugcauguucaagugaagaaucuugacgggacccaguacgacccuacagaugacauccccgccguccugggagcuaucgauuucaaaggcacgguguucggcgucgccagccagcgcgacgugucugggacccaggaacaaggacacuaugcgacaagagcucacgaggcccauauugauaccacagacccuaaguacgcccccaagcucggcaccauccugauuaaauccgaaagcacggauuuuacaaccaaccagccgauccgguucaccccuguugggaugggagacaauaacuggagacagugggagcugcccgauuacuccggccgccucacacugaauaugaaccuugcucccgccgugucuccuagcuuuccgggggagcggauucuguucuuuagauccaucguccccagcgcuggaggcuucggcucuggguauaucgacugccucauuccucaggaaugggugcaacacuuuuaccaggaggccgcgcccucccagagcgccguugcucuggugcgcuaugucaauccugauaccggacggaacaucuucgaagccaaacuucauagagagggcuuucugacaguggcuaauucugggaacaaucccauugugguuccucccaacggauacuuccgcuuugaagccugggucaaucaguucuauacgcucgcgccgaugggcagcgggcaaggccggagacgcgcccaguga

SEQ ID NO: 28677 - RNA, 1614 nt, Artificial Sequence
  derived and/or modified sequence opt5 from major_capsid_protein__Norovirus__AJP13623
augaagauggccagcaacgacgcugcccccuccaaugauggcgcggcugggcuggugccugaggucaacaaugaaaccauggcccucgagccgguugccggagcuucuaucgccgcuccccugacaggccagaacaaugugauugacccuuggaucagacuuaacuucgugcaagcccccaauggggaauuuacggucagcccucggaacucccccggagaggugcugcucaaucuggaacuuggcccugagcugaacccguaccucgcgcaccugucucgcauguauaauggguacgccggaggcguugaggugcagguccugcucgcuggcaacgccuucaccgcugggaaacugguguuugccgcgguucccccucauuucccccuugaaaauauuagcccuggacagaucacaauguuuccccacgugauuaucgaugucagaacccuggagccggugcuccugccucuucccgacgugcggaacaauuucuuucauuauaaccagcaaaacgaaccucgcaugagacuggucgccaugcucuacacaccccugcgguccaauggcucuggggaugacguuuucaccgugagcugccgcgugcugacaagacccuccccugauuuugacuucaacuaucucgucccgcccaccguggagagcaagacgaaaccuuuuacccugcccauccuuacaauuggagagcugaccaauucucgguucccuguucccaucgaugaacucuacacauccccgaacgagagccuggugguccagccucagaauggccgcugugcucuugacggggaacugcagggaaccacgcaacuccugcccacagccauuugcucuuuuagaggccggaucaaccagaagguguccggcgauaaucacguuuggaacaugcaagugaccaauauuaacgggacaccuuucgaccccaccgaggaugucccugcuccccugggaaccccggacuucagcggcaaacucuuuggggugcugucucagcgcgaccaugauaaugccuguagaucccacgacgccgucaucgcuacagauagcgcgaaguucacgccuaaacuuggagccauucagaucggcaccugggaagaggacgaugugcacaucaaccagcccacaaaguuuacccccguugggcuguucgagcgggaaggauuuaaucaguggacacucccuaacuauuccggcgcucugacccuuaauaugggccuggccccgcccguggccccuacguuccccggggagcaaauucucuuuuuccgcucucauaucccucugaagggaggcgucgcugaccccgugauugauugccugcucccucaggaauggauccagcaccuguaccaggagagcgcccccucccaaacagacguugcgcuuauuagauuuaccaacccggauaccgggcgggugcuguucgaagcuaaacuccauagaagcggauacaucacagucgccaacaccggcucucgcccuaucguggugcccgccaauggguauuuucgguucgacuccuggguuaaccaguuuuacagccuggcuccuaugggcacaggaaauggcagacgccggguccagaagggguga

SEQ ID NO: 28678 - RNA, 1623 nt, Artificial Sequence
  derived and/or modified sequence opt5 from major_capsid_protein__Norovirus__AJW67354
augaugauggccagcaaggacgcucccaccuccccugauggcgccucuggggcgggacagcuggugccggaggcuaacacagccgaacaaaucagcauggaccccgucgccggcgcuuccacggccguugcuaccgccgggcaggucaauaugauugauccuuggaucuucaacaauuuugugcaggcgccccagggagaguucacaauuucuccuaacaauacccccggcgacauccucuuugaucugcaacuugggccucaccugaacccguuccucgcccaucugagccagauguacaauggaugggucggcaacaugagagugcggauucuucuggcuggcaaugccuuuacagcugggaaaaucaucauuugcuguguucccccuggauucgacgcccgcauccucaccauugcgcaggccacacuguuuccccaccugaucgcugaugugagaacccucgaaccugucgagcugccccuugaagacgugcggaacguucuguaucauaauuccucucagccgcaaccuacgaugcgccucguggccaugcuguacacaccccuuagaaccggcgggggaagcggcgggaccgaugcuuucgucguggccggacgggugcugacaugcccugcccccgacuuuuccuuccucuuucuggugcccccuagcguugagcagaagacccgcguguucucugugccgaacauuccccugaaagaucucuccaauagcagagucccugugcccguucagggcauguuugugucuccugacgucaaccaguccgugcaauuccagaauggccggugucagaucgaugggcaacugcagggaacgacacccguuagccuuucucagcugugcaagauucgcggcaaaaccuccagcaacgcuagagugcucaaccuguccgaggucgacgggacaccguucaucccucuugaaucucccgcgccugugggauuucccgaccugggcgggugugauuggcacgucaauuucaccuuucagacccaagaccgggauccuagccaguccgugacauucgccacgaacgacgcuagcuuuguucccuaucucggaucuguguccccgcauaauggcgagggcuuccaggccggggauaucauuggaagccugggcuggaucucugccccuagcgacaacucccaguuuaaugucugggcuauucccaaguacgggucuagccugcccgaugugacccaccucgccccugcgguuuucccgcccggauuuggcgaagugauccuguauuucuacuccacauuuccugggagcggccaacccucucagcuucaggucccuugccugcucccccaggaguucauuacccacuuuuguaacgagcaagcuccuaucgccggagaagccgcucugcuucauuauguggaccccgauacaggccgcaaucugggggaguucaagcucuacccggacggauucaugaccugcgugccuaacuccguuagcucuggcccccagacgcugccuaucaauggggucuuuguguucguguccugggucagcagauuuuaccagcugaaacccgugggaacagccuccgcugcccggcgccucggccugagacggauuuga

SEQ ID NO: 28679 - RNA, 1644 nt, Artificial Sequence
  derived and/or modified sequence opt5 from major_capsid_protein__Norovirus__AJW67357
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagaguucggaaccacccucugcaugugcagcuuaagaaucuggacgggacacccuacgauccuacggacgagguccccgccgugcucggagcuaucgacuucaaaggcaccgucuucggcguggccucccaacgcaacacaaccgggaauagcaucggagccacaagagcucacgaaguucacauugauaccacgaacccgcgguauacaccuaagcugggcuccgugcugauguacucugagagcuccgacuuugaugacgggcagcccaccagauucacccccaucggaaugggcgccgaugacuggcaucagugggagcucccugaauacagcgggcaccugacacuuaauaugaaccuggcgccggcugucgcccccgccuuuccuggagagcgcauucucuucuuucggucugugguucccuccgcuggcggcuaugggagcggacauaucgauugccugauuccucaggaaugggugcaacacuucuaccaggaggccgcucccucucagagcgccgucgcgcuuaucagauaugugaauccugacaccggccgcaacaucuuugaagccaagcugcaccgggagggguucgugacaguugcuaauuccggaaacaaucccauugucgugccgccuaacggcuacuuuagauucgaggccugggugaaucaguuuuauacgcucacccccauggggacaggccaaggacgccggagaauccaguga

SEQ ID NO: 28680 - RNA, 1644 nt, Artificial Sequence
  derived and/or modified sequence opt5 from major_capsid_protein__Norovirus__AJW67359
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccaggcuucucgcuccgcggacagcaccgauucugcccccagaguucggaaccacccucugcaugugcagcuuaagaaucuggacgggacccccuacgauccuacagacgagguccccgcugugcucggagccaucgacuucaaaggcacggucuucggcguggccucccaacgcaacaccacagggaauagcaucggagcuaccagagcccacgaagcgcacauugauacaaccaacccgcgguauacgccuaagcugggcuccguucugauguacucugagagcuccgacuuugaugacgggcagcccacaagauucacccccaucggaaugggcgcugaugacuggcaucagugggagcucccugaauacagcgggcaccugacccuuaauaugaaccuggccccggccguggcucccgccuuuccuggagagcgcauucucuucuuucggucugucgugcccuccgcuggcggcuaugggagcggacauaucgauugccugauuccucaggaauggguucaacacuucuaccaggaggccgcgcccucucagagcgccguggcucuuaucagauaugucaauccugacacaggccgcaacaucuuugaagccaagcugcaccgggagggguucauuaccguggcuaauuccggaaacaaucccaucgugguuccgccuaacggcuacuuuagauucgaggccugggucaaucaguuuuauacacucacgcccauggggaccggccaaggacgccggagagugcaguga

SEQ ID NO: 28681 - RNA, 1644 nt, Artificial Sequence
  derived and/or modified sequence opt5 from major_capsid_protein__Norovirus__AJW67362
augaagauggccagcaacgacgcugcccccuccaaugauggcgcggcuaaccuggugccugaggccaccaaugaagucauggcccucgagccgguugugggggcuucuaucgccgcucccguggucggacagcaaaacauuaucgacccuuggauuagagaaaauuucgugcaggcgccccagggcgaguuuacaguuagcccucggaacucccccggggaaaugcugcuuaaucuggagcucggaccugagcugaacccguaccuuucucaccugagccgcauguauaauggcuacgccgggggaaugcaagugcaggucgugcucgccggcaacgcuuucacggccggcaaaaucauuuuugcugccguucccccucauuuccccguggaaaauaucuccgcggcccagaucaccaugugcccucacgucauuguggaugugagacagcuggagcccguccugcucccgcugccugacauccggaaccgcuuuuuccauuauaaucaggaaaacacacccagaaugcggcuuguugcuaugcuguacaccccucuccgcgccaauucuggggaggauguguuuacagugagcuguagaguccugacccggcccgcucccgacuucgaguuuacauuccuugugccuccgaccguugaauccaagacgaaacccuuuacccugccuauucucacacugggagagcugagcaacucucgcuuccccgccccuaucgauaugcucuauaccgaccccaacgaagccauugugguccaaccgcagaauggcagaugcacacuggaugggacccuucagggaacgacacagcuggugccuacccaaaucuguuccuuucggggcacacucauuagccagaccucucgcuccgcugacagcaccgauucugcgcccagaguucggaaccacccucugcaugugcagcuuaagaaucuggacgggacacccuacgauccuacggacgagguccccgccgugcucggagcuaucgacuucaaaggcaccgucuucggcguggccucccaacgcaacacaaccgggaauagcaucggagccacaagagcucacgaaguucacauugauaccacgaacccgcgguauacaccuaagcugggcuccgugcugauguacucugagagcaccgacuuugaugacgggcagcccaccagauucacacccaucggaaugggcgccgaugacuggcaucagugggagcucccugaauacuccgggcaccugacccuuaauaugaaccuggcgccggcugucgcccccgccuuuccuggagagcgcauucucuucuuucggagcgugguucccucugcuggcggcuauggguccggacauaucgauugccugauuccucaggaaugggugcaacacuucuaccaggaggccgcucccagccagucugccgucgcgcuuaucagauaugugaauccugacacaggccgcaacaucuuugaagccaagcugcaccgggagggguucauuacgguggcuaauagcggaaacaaucccaucguugucccgccuaacggcuacuuuagauucgaggccugggugaaucaguuuuauacccucacacccauggggaccggccaaggacgccggagagugcaguga

SEQ ID NO: 28682 - RNA, 1617 nt, Artificial Sequence; identical to SEQ ID NO: 28248
  derived and/or modified sequence opt5 from major_capsid_protein__Norovirus__AJW67368

SEQ ID NO: 28683 - RNA, 1617 nt, Artificial Sequence; identical to SEQ ID NO: 28248
  derived and/or modified sequence opt5 from major_capsid_protein__Norovirus__AJW67371

SEQ ID NO: 28684 - RNA, 1623 nt, Artificial Sequence
  derived and/or modified sequence opt5 from major_capsid_protein__Norovirus__AJW67374
auggccagcaacgacgcugcccccuccaaugauggcgcggcuucucuggugccugaggccaucaacgaaaccaugccgcucgagcccgucgccggggcuagcauugccgcuccuguugccggacagacaaauaucauugaccccuggaucagaacgaacuucgugcaagcgccuaauggcgaauuuaccgugucuccccggaacuccccuggggagauucugcuuaaucuggaacucggaccggaucugaaccccuaccuugcccaccugagccgcauguauaauggcuacgcugggggagucgaggugcagguucuccuggccggcaacgcuuucacagccggcaagauccuguuugcggccaucccucccaauuucccuguggacaugauuucccccgcucagaucaccaugcucccgcaucugauugucgaugugagaacacuugagccuaucaugauuccccugccugacguucggaacguguuuuaucacuucaauaaccagccccaaccccgcaugagacucgucgccaugcuguacaccccucuucggucuaaugggagcggagaugacguguuuacaguguccugccgcguccugaccagaccgacgcccgauuucgaauuuaucuaucucguuccucccagcguggagucuaagaccaagccuuucacacugcccauucugaccaucuccgaacucacaaacagccgguuuccgaucccuauugagcagcuguacaccgcucccaacgagaauaacgugguccagugucagaauggccgcugcacgcuugacggggaacugcaaggaacaacccagcuccugucuuccgccguguguagcuauagaggccggacaguugccaacucuggggauaauugggaccagaaccuucugcagcucaccuacccuuccggagcuagcuacgaucccaccgacgaggugccugcgccccugggcacacaagacuucuccggcauccuguaugggguccucacgcaggauaaugugucugaaggaaccggcgaggccaaaaacgcuaaggggguuuacauuagcacaaccuccggacgcuuuacaccgaaaaucggcaccauugggcugcauagcaucacggaaaaugugcacccuaaccagcaaucuagauucacacccgucggaguggcccagaaugagaacacccccuuccagcaguggguccuuccucauuaugccggcgcucuggcccucaauaccaaccuggcgccggcuguggcccccacauuuccuggcgagcaacuucuguucuuucggucccgcguucccugcgugcaggggcucagaggacaggacgccuucaucgauugucugcugccucaggaaugggucaaucacuuuuaccaagaggcugcccccagccaggcugacguggcccucauucgguauguuaacccugauaccggcagaacacuguucgaagcgaaacuucaccgcucuggguuuaucacggugagccauaccggaaacuacccccuggucgugccgccuaauggccacuuccgguuugacuccugggugaaccaguucuauucucucgcccccauggggacaggcaauggaagacgccggguucaguga

SEQ ID NO: 28685 - RNA, 1635 nt, Artificial Sequence
  derived and/or modified sequence opt5 from major_capsid_protein__Norovirus__AJW67377
augaugauggccagcaaggacgcuacccccuccgccgauggcgcgacaggggcuggacagcuggugccugaggucaacacggccgacccgauccccauugauccuguugccggcucuagcaccgcucucgccacagcugggcaagugaaucugaucgaccccuggauuaucaacaauuucgugcaggccccucagggagaauuuaccauuucccccaacaauacaccuggcgauguccuuuucgaccugcagcucgggccgcaccugaaccccuuucuuucucaucugagccaaauguacaauggaugggugggcaacaugagaguucgggugguccucgcgggcaaugccuucaccgcugggaaagugaucaucugcuguguuccucccggauuucagucccgcacacugucuauugcccaggcuacccuguucccucacgugaucgccgaugucagaacgcucgaccccguggaggugccgcuggaagauguccggaacguucuuuaucauaauaacgacacccagccuacaaugcgccugcucugcaugcuguacacaccccuuagaaccggcggggcgagcggaggcaccgauuccuuugugguggccgggcggguccugacguguccuggacccgacuucaauuuucucuuccuggugcccccuacaguugagcaaaagacccgcccguuuacagugcccaacauuccucugaaauaucucagcaauucuagaauccccaacccuauugaaggcaugucccugagccccgaucagacccagaacguccaguuccaaaauggccggugcaccaucgacgggcagccgcuuggaacaacgccugugucuguuucccagcuguguaaguuucgcggcagaauuaccagcgggcaaaaagugcucaaccugacagagcuugacggaucucccuucauggcuuucgccgcuccugcccccgccggcuuuccugaucugggguccugcgacuggcacaucgagaugagcaagauccccaauuccucuaccgaaagcaacccgauugucgucaauuccgugaagccuaacagccagcaguucgugccccaucucucuuccaucacacuggaugacaauguuagcucuggaggcgauuacauuggcaccauccaguggacgagcccucccuccgacucugggggagcuaacacaaauuuuuggaaaauuccgaacuauggcagcucccuggcggaggccagccaacucgcucccgccguguacccucccggguucaaugaagucaucguguauuuuauggccucuaucccuggacccaaccaguccggcagcccuaaucugguucccugucuucugccgcaggaguacauuacccacuucaucucugagcaggcuccuauucaaggggaagccgcgcuccugcacuacguggaucccgacaccaaccggaaucuuggcgaguuuaagcuguauccuggaggcuaccucacaugcguccccaacuccagcuccaccgggccgcagcagcugccucuggauggaguguucguguuugcuucuuggguuagccgcuucuaucagcucaaacccgucggcacagccgggccugccagaggacggcugggcgugcgcagauga

SEQ ID NO: 28686 - RNA, 1617 nt, Artificial Sequence
  derived and/or modified sequence opt5 from major_capsid_protein__Norovirus__AJX18190
auggccagcaacgacgcuacccccuccaaugauggcgccgcggggcuggugccugagucuaacaaugaagcuauggcccucgagccggucguuggagccagccuggcugcccccgugacaggccagacgaacaucauugacccuuggaucagaaccaauuucgugcaagcucccaacggggaauuuacagucuccccucgcaauucucccggagagauucuugugaaccuggaacucggcccugagcugaauccguaccuugcccaccuggcgcggauguauaacggguacgccggaggcauggagguucaggugaugcucgcuggcaaugccuucaccgcugggaagaucauuuuugccgcggugcccccuuauuuccccgucgaaaaccugagcccuccccagaucacaauguuuccgcauguuaucauugaugugagaacccuggagccuguccuccugcccaugccugacgugcgguccacacuuuuccacuuuaaucagaaagaugaacccaagaugcgccugguggccaugcucuacacgccccugagaucuaacggaagcggcgacgaugucuucaccguuuccugccggauccuuacccgcccuagcccggaguuugacuucacauaucuggugcccccuaccguggagucuaaaacaaagcccuuuacccucccuguccugacgcugggggaacucuccaauagcagauucccccugucuauugaugagauggugacauccccgaacgaaagcaucguugugcaaccucagaacggacgggucacccuugacggcgagcugcucgggacaacccagcugcaggcuuguaauauuugcucuauccgcggaaaagugaccggccaaguucccaacgaacagcauauguggaaucuugagauuacaaaccugaauggcacgcaguuugauccuaccgacgaugugcccgccccucucgggguccccgacuucgcuggagagguguucggcguccugucccagagaaaccgcggggaaagcaauccggccaaccgggcccacgacgcugugguugcgacauacuccgauaaguauaccccuaagcugggacucgugcaaaucggcacauggaauaccaacgacgucgagaaucagcccacgaaauuuacacccaucgggcugaacgaaguggccaauggacauagauucgagcaguggacccuuccucgguacucuggcgcucugacccucaacaugaaucuggccccggccguugcuccccuuuuuccuggcgaacgccuccuguucuuuagaagcuacgugccccugaaagggggauucggcaacccugccauugauugucuggucccccaagagugggugcagcacuuuuaucaggaguccgcgccuagccucggggacguggcucugguucgguacgucaaccccgauacaggaagagugcuuuucgaagccaagcugcacaagggcggguuucucaccgugucuuccacaagcacgggcccggucgugguuccugccaauggauauuuccgcuuugacucuugggugaaccaguucuacagccuggcucccaugggcaccgggaauggacggagacgcuuucaauga

SEQ ID NO: 28687 - RNA, 1617 nt, Artificial Sequence; identical to SEQ ID NO: 28248
  derived and/or modified sequence opt5 from major_capsid_protein__Norovirus__AJX18193

SEQ ID NO: 28688 - RNA, 1623 nt, Artificial Sequence; identical to SEQ ID NO: 27262
  derived and/or modified sequence opt5 from major_capsid_protein__Norovirus__AJZ77004

SEQ ID NO: 28689 - RNA, 1623 nt, Artificial Sequence; identical to SEQ ID NO: 26983
  derived and/or modified sequence opt5 from major_capsid_protein__Norovirus__AJZ77010

SEQ ID NO: 28690 - RNA, 1623 nt, Artificial Sequence
  derived and/or modified sequence opt5 from major_capsid_protein__Norovirus__AJZ77013
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgaaguccaggugauccuugccggcaaugcuuuuacggccgggaaaauuaucuucgcggccguuccucccaacuuuccuaccgagggacugucucccagccaggugacaauguucccgcauaucauugucgacgugagacaacucgagccugugcugaucccccugccugauguccggaauaacuuuuaucacuacaaucaguccaacgaccccaccauuaagcucaucgcuaugcuguauacaccccuucgcgccaauaacgcuggcgaugacguuuucaccgugagcugcagagugcugacacggccuucuccggauuuugacuucauuuuucucgugcccccuaccgucgaaucccgcacgaaacccuucagcguuccuauccugaccguggaggaaaugacaaacucuagauuucccauuccgcuugagaagcuguucaccgggccuuccagcgccuucgucgugcagccccagaauggacgguguacaaccgauggcguucuccuggggacgacacaacugucuccugugaacaucugcaccuuucgcggagacgucacacauaucaccggcuccagaaauuacaccaugaaccucgccacacagaauuggaacagcuaugaucccacggaggaaauuccugcuccccugggcaccccggacuucguggggaaaauccagggaguccuuacacagaccacacgggcggacggcuccacccgcgggcacaaggccacgguguacacaggaucugcugauuuugccccuaagcugggcagaguucaauucgccaccgacaccgauaaugacuuugaugcuaaccagaauacaaaauucacccccgugggggucauucaggacggagauacagcccaucggaacgagccccaacagugggugcucccuagcuacuccggccgcaauagccacaacguucaccuggcgccggcuguggcccccacguuuccuggcgaacagcuucuguucuuuagaucuaccaugcccggguguuccggauauccuaauauggaccucgauugccugcugccccaggaguggguccaauacuucuaucaggaagccgcuccugcccagagcgacguggcucuccugcgguuugugaaccccgauacaggcagaguucuuuucgaguguaagcugcauaaaucuggguacgucaccguggcccacacaggacagcaugaccucgugaucccgccuaauggcuauuuucgcuucgacagcugggucaaccaauucuacacccuggcgcccauggggaacggcacgggacggagacgcgcccuuuga

SEQ ID NO: 28691 - RNA, 1623 nt, Artificial Sequence; identical to SEQ ID NO: 26993
  derived and/or modified sequence opt5 from major_capsid_protein__Norovirus__AJZ77015

SEQ ID NO: 28692 - RNA, 1623 nt, Artificial Sequence; identical to SEQ ID NO: 26991
  derived and/or modified sequence opt5 from major_capsid_protein__Norovirus__AJZ77019

SEQ ID NO: 28693 - RNA, 1623 nt, Artificial Sequence; identical to SEQ ID NO: 27085
  derived and/or modified sequence opt5 from major_capsid_protein__Norovirus__AJZ77022

SEQ ID NO: 28694 - RNA, 1623 nt, Artificial Sequence; identical to SEQ ID NO: 27357
  derived and/or modified sequence opt5 from major_capsid_protein__Norovirus__AJZ77027

SEQ ID NO: 28695 - RNA, 1623 nt, Artificial Sequence; identical to SEQ ID NO: 27139
  derived and/or modified sequence opt5 from major_capsid_protein__Norovirus__AJZ77030

SEQ ID NO: 28696 - RNA, 1623 nt, Artificial Sequence; identical to SEQ ID NO: 26482
  derived and/or modified sequence opt5 from major_capsid_protein__Norovirus__AJZ77033

SEQ ID NO: 28697 - RNA, 1623 nt, Artificial Sequence; identical to SEQ ID NO: 26482
  derived and/or modified sequence opt5 from major_capsid_protein__Norovirus__AJZ77036

SEQ ID NO: 28698 - RNA, 1623 nt, Artificial Sequence
  derived and/or modified sequence opt5 from major_capsid_protein__Norovirus__AKE31849
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgcuggaggcuucgaaguccaggugauccuugccggcaacgcuuuuacggccgggaaaauuaucuucgcggccguuccucccaauuuuccuaccgagggacugucccccucucaggugacaauguucccgcauaucauugucgacgugagacaacucgagccugugcugaucccccugccugauguccggaacaauuuuuaucacuacaaccagagcaaugacuccaccauuaagcucaucgcuaugcuguauacaccccuucgcgccaacaacgcuggcgaugacguuuucaccgugagcugcagagugcugacacggcccucuccugauuuugacuucauuuuucucgucccgcccaccguggaaucccgcacgaaaccuuucagcguucccgugcugaccgucgaggaaaugacaaauucuagauuuccuaucccccuugagaagcuguucaccgggccguccagcgccuucgugguucagccucagaacggacgguguacaaccgauggcgugcuccuggggacgacacaacugucucccgucaauauuugcaccuuucgcggagacgugacacauaucuccggcagcagaaacuacaccaugaaucucgccucccagaacuggaacucuuaugauccuaccgaggaaauccccgcuccucugggcacacccgacuucgucgggaaaauucagggagugcuuacgcaggcgacccggacaaauggcagcacccgcgggcacaaggccacaguuuacaccggauccgcugacuuuagcccgaagcugggcagagugcaauucgccacggauacagacaaugauuuugagaccaaccagaauaccaaauucacaccugucggggugauccaggacggaucuaccacaccccggaacgaaccccaacaguggguucucccuuccuacagcggccgcaauauucauaacgugcaccuggccccggcugucgcccccacguuuccuggcgagcagcuucuguucuuuagaucuaccaugcccggguguagcggauauccuaauauggaucucgacugccugcugccccaggaaugggugcaauacuucuaucaggaggcggcuccugcccaguccgauguggcccuccugcgguuuguuaaccccgacacaggcagaguccuuuucgaguguaagcugcacaaaucuggguacgugaccguggcucauacaggacagcacgaucucgucaucccgccuaacggcuauuuucgcuucgacagcugggugaaucaauucuacacccuggcccccauggggaacggcacgggacggagacgcgcucuuuga

SEQ ID NO: 28699 - RNA, 1623 nt, Artificial Sequence
  derived and/or modified sequence opt5 from major_capsid_protein__Norovirus__AKE31852
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugaucgacccuuggaucagaaauaacuucguucaggcucccggcggggaauuuacaguguccccucggaaugcccccggagagauucuguggucugcgccucuuggcccggaucugaaccccuaccucagccaccuggcccgcauguauaauggguacgucggaggcuucgaagugcagguuauccuugcuggcaacgccuuuacggcugggaaaauuaucuucgccgcggugccucccaauuuuccuaccgagggacugucccccucucaggucacaauguucccgcauaucauuguggacgugagacaacucgagccuguccugaucccccugccugauguucggaacaauuuucaccauuauaaccagagcaaugaccccaccauuaagcucaucgccaugcuguacacaccccuucgcgcuaacaacgccggcgaugacguguucaccguguccugcagaguccugacacggccuagcccggauuuugacuucauuuuucucgugcccccuaccguugaaucucgcacgaaacccuucuccgugccuguccugaccguggaggaaaugacaaauagcagauuucccaucccgcuugagaagcuguucaccgggccuucuuccgcuuucguugugcagccccagaacggacgguguacaaccgauggcguccuccuggggacgacacaacugagcccugugaauauuugcaccuuucgcggagacgucacacacauccccggcucuagaaacuauaccaugaaucucgccucccagaacuggaauagcuacgauccuaccgaggaaauccccgccccgcugggcacaccugacuucguggggaaaauucagggaguucuuacgcagaccacacggaccaacggcuccacacgcgggcauaaggcuaccguguauacgggaucugcggacuuuagccccaagcugggcagaauccaauucgccacagauaccgacaaugauuuugagaccaaccagaauacaaaauucacccccgucggggugauucaggacggauccacaacgccucggaacgaaccgcaacaguggguucuccccagcuacucuggccgcaauacccacaacgugcaccuggcuccugccgucgcccccacauuuccuggcgagcagcuucuguucuuuagauccaccaugcccggguguagcggauacccuaauauggaucucgacugccugcugccccaggaaugggugcaauauuucuaccaggaggcugccccggcgcagucugauguggcucuccugcgguuuguuaacccugacacaggcagaguccuuuucgaguguaagcugcauaaaagcggguaugugaccguggcccacacgggacagcaugaucucgucauucccccuaacggcuacuuucgcuucgacuccugggugaaucaauucuauacccuggcccccauggggaacggcacaggacggagacgcgcucuuuga

SEQ ID NO: 28700 - RNA, 1623 nt, Artificial Sequence
  derived and/or modified sequence opt5 from major_capsid_protein__Norovirus__AKE31855
augaagauggccagcuccgacgcuaaccccucugauggcagcaccgccaaucuggugccugaggucaacaaugaaguuauggcgcucgagccgguggugggggcugccaucgccgcucccgucgccggacagcaaaacgugauugacccuuggaucagauccaauuucguucaggcucccggcggggaauuuacagugucuccucggaacgcccccggagagauucuguggagcgcgccucuuggcccggaucugaaucccuaccucucccaccuggcccgcauguauaacggguacgcuggaggcuucgucgugcagguuauccuugccggcaaugcuuuuacggccgggaaaauuaucuucgcggccgugccucccaacuuuccuaccgaaggacugucucccagccaggucacaauguucccgcauaucauuguggacgcuagacaacucgagccugugcugaucccccugccugauguccggaauaacuuuuaucacuacaaucaguccaacgaccccaccauuaagcucaucgccaugcuguauacaccccuucgcgcuaauaacgccggcgaugacguuuucaccgugagcugcagagugcugacacggccuucuccggauuuugacuucauuuuucucgugcccccuaccgucgagucccgcacgaaacccuucagcguuccugugcugaccgucgaagagaugacaaacucuagauuucccaucccgcuugaaaagcuguucaccgggccuuccagcgccuucgugguucagccccagaauggacgguguacaaccgauggcgugcuccuggggacgacacaacugucuccugucaacauuugcaccuuucgcggagacgugacacauaucuccggcagcagaaauuacaccaugaaccucgcuucccagaauuggaacucuuaugaucccaccgaggagaucccugcgccccugggcacaccggacuucgucgggaaaauucagggagugcuuacgcagaccacaaagaccgacggcagcacacgggggcacaaggccaccguuuacacgggauccgcugauuuuagcccuaaacugggccgcgugcaauucgccacagacaccgauaaugacuuugaaaccaaccagaauacaaaguucacccccgucggggugauccaggauggaucuacaacgcccagaaacgagccucaacaguggguucucccguccuacagcggccggaauacccauaacgugcaccuggcccccgcugucgccccuacauuucccggcgaacagcuucuguucuuucgcucuaccaugccuggguguagcggauaucccaauauggaccucgauugccugcugccucaggagugggugcaauacuucuaucaggaagcggcucccgcccaguccgacguggcccuccugagauuuguuaacccggauacaggccggguccuuuucgaguguaaacugcacaagucuggguacgugaccguggcucauacgggacagcacgaccucgucauuccucccaauggcuauuuuagauucgauagcugggugaaccaauucuacacccuggccccuauggggaacggcacaggacgccggagagcucuuuga
